United States Patent 11,446,398 (REGULATED BIOCIRCUIT SYSTEMS) - sequence listing, part 74

SEQ ID NO: 175008 - DNA, 3319 bp, Homo sapiens
  Payload ID: 14361
  Gene Symbol: RXFP2
  Gene Name: relaxin/insulin-like family peptide receptor 2
  Uniprot ID: Q8WXD0
  ENST ID: ENST00000298386
  CDS Start-End: 72-2336
tgaacttactacatcagaactcctgctgaggtataagaggatacgtctaataactcaattgctgtaaacctatgattgtttttctggtttttaaacatctcttcagcctcagattgattacaatgttctttctacttcatttcatcgttctgatcaatgtcaaagattttgcactgactcaaggtagcatgatcactccttcatgccaaaaaggatattttccctgtgggaatcttaccaagtgcttaccccgagcttttcactgtgatggcaaggatgactgtgggaacggggcggacgaagagaactgtggtgacactagtggatgggcgaccatatttggcacagtgcatggaaatgctaacagcgtggccttaacacaggagtgctttctaaaacagtatccacaatgctgtgactgcaaagaaactgaattggaatgtgtaaatggtgacttaaagtctgtgccgatgatttctaacaatgtgacattactgtctcttaagaaaaacaaaatccacagtcttccagataaagttttcatcaaatacacaaaacttaaaaagatatttcttcagcataattgcattagacacatatccaggaaagcattttttggattatgtaatctgcaaatattatatctcaaccacaactgcatcacaaccctcagacctggaatattcaaagacttacatcagctaacttggctaattctagatgacaatccaataaccagaatttcacagcgcttgtttacgggattaaattccttgtttttcctgtctatggttaataactacttagaagctcttcccaagcagatgtgtgcccaaatgcctcaactcaactgggtggatttggaaggcaatagaataaagtatctcacaaattctacgtttctgtcgtgcgattcgctcacagtgctgtttctgcctagaaatcaaattggttttgttccagagaagacattttcttcattaaaaaatttaggagaactggatctgtctagcaatacgataacggaactatcacctcacctttttaaagacttgaagcttctacaaaagctgaacctgtcatccaatcctcttatgtatcttcacaagaaccagtttgaaagtcttaaacaacttcagtctctagacctggaaaggatagagattccaaatataaacacacgaatgtttcaacccatgaagaatctttctcacatttatttcaaaaactttcgatactgctcctatgctccccatgtccgaatatgtatgcccttgacggacggcatttcttcatttgaggacctcttggctaacaatatcctcagaatatttgtctgggttatagctttcattacctgctttggaaatctttttgtcattggcatgagatctttcattaaagctgaaaatacaactcacgctatgtccatcaaaatcctttgttgtgctgattgcctgatgggtgtttacttgttctttgttggcattttcgatataaaataccgagggcagtatcagaagtatgccttgctgtggatggagagcgtgcagtgccgcctcatggggttcctggccatgctgtccaccgaagtctctgttctgctactgacctacttgactttggagaagttcctggtcattgtcttccccttcagtaacattcgacctggaaaacggcagacctcagtcatcctcatttgcatctggatggcgggatttttaatagctgtaattccattttggaataaggattattttggaaacttttatgggaaaaatggagtatgtttcccactttattatgaccaaacagaagatattggaagcaaagggtattctcttggaattttcctaggtgtgaacttgctggcttttctcatcattgtgttttcctatattactatgttctgttccattcaaaaaaccgccttgcagaccacagaagtaaggaattgttttggaagagaggtggctgttgcaaatcgtttcttttttatagtgttctctgatgccatctgctggattcctgtatttgtagttaaaatcctttccctcttccgggtggaaataccagacacaatgacttcctggatagtgatttttttccttccagttaacagtgctttgaatccaatcctctatactctcacaaccaacttttttaaggacaagttgaaacagctgctgcacaaacatcagaggaaatcaattttcaaaattaaaaaaaaaagtttatctacatccattgtgtggatagaggactcctcttccctgaaacttggggttttgaacaaaataacacttggagacagtataatgaaaccagtttcctagcaatcattttggatcactggactttcagtggactacctaaaacaggggacagcttttggaagatgacatctgcaatgcttttcatctttaccaacggcaagcctttctgcacagagagcacagcagaatggctcctgtcactgcattccaatggcagctgtactatctaccaaccatgctgaggacagcaccaaaggttcctctcctcaccccacatgcctgaaaagcacatgtgaattcgtgtatagtgggctgaggtgcagctgatctctagctaatcaacacaacccaccaacaaatgaccacaggttggcactgtgtggtctttcacatcgggttgcactgtccatgaaatagaaacactcacaacatctgattccagtgtggccataataacagaaatctaacaactctttccttgccttttcaatatcaaataaaaccatcagcatcctgctggattgatagcaaaggatttccaaaatattcatctacccgaagtcctcctctgtgaaggccggtggagtagccactttgaaaacagaacttccaaccaggttaccatgtctaacctatgaccagagagtcacactgatgaagcctcataccatttgccttttggattttatttaatatcagaagagatgaattcttaagatatttttctgaaggttgcccagggcacaaacaaattggacactttcactgctaaaaagtacactttaatattcttaaagtataatttctttagagcagtatccctattgctggcaagttctgctttcataaaatatgcagataagaagtgttaaatgggattcaagaattatggttttatttgggactgtttgcatactcacaatggttttgttctcattgtttttaacaaaaaagcaatgaagtttggggtggttttttgaaaacgaaactgaaaaaaattatatgtgaaaatgagaactgggtaaataaaattatattttgca

SEQ ID NO: 175009 - DNA, 2731 bp, Homo sapiens
  Payload ID: 14361
  Gene Symbol: RXFP2
  Gene Name: relaxin/insulin-like family peptide receptor 2
  Uniprot ID: Q8WXD0
  ENST ID: ENST00000380314
  CDS Start-End: 72-2264
tgaacttactacatcagaactcctgctgaggtataagaggatacgtctaataactcaattgctgtaaacctatgattgtttttctggtttttaaacatctcttcagcctcagattgattacaatgttctttctacttcatttcatcgttctgatcaatgtcaaagattttgcactgactcaaggtagcatgatcactccttcatgccaaaaaggatattttccctgtgggaatcttaccaagtgcttaccccgagcttttcactgtgatggcaaggatgactgtgggaacggggcggacgaagagaactgtggtgacactagtggatgggcgaccatatttggcacagtgcatggaaatgctaacagcgtggccttaacacaggagtgctttctaaaacagtatccacaatgctgtgactgcaaagaaactgaattggaatgtgtaaatggtgacttaaagtctgtgccgatgatttctaacaatgtgacattactgtctcttaagaaaaacaaaatccacagtcttccagataaagttttcatcaaatacacaaaacttaaaaagatatttcttcagcataattgcattagacacatatccaggaaagcattttttggattatgtaatctgcaaatattatatctcaaccacaactgcatcacaaccctcagacctggaatattcaaagacttacatcagctaacttggctaattctagatgacaatccaataaccagaatttcacagcgcttgtttacgggattaaattccttgtttttcctgtctatggttaataactacttagaagctcttcccaagcagatgtgtgcccaaatgcctcaactcaactgggtggatttggaaggcaatagaataaagtatctcacaaattctacgtttctgtcgtgcgattcgctcacagtgctggatctgtctagcaatacgataacggaactatcacctcacctttttaaagacttgaagcttctacaaaagctgaacctgtcatccaatcctcttatgtatcttcacaagaaccagtttgaaagtcttaaacaacttcagtctctagacctggaaaggatagagattccaaatataaacacacgaatgtttcaacccatgaagaatctttctcacatttatttcaaaaactttcgatactgctcctatgctccccatgtccgaatatgtatgcccttgacggacggcatttcttcatttgaggacctcttggctaacaatatcctcagaatatttgtctgggttatagctttcattacctgctttggaaatctttttgtcattggcatgagatctttcattaaagctgaaaatacaactcacgctatgtccatcaaaatcctttgttgtgctgattgcctgatgggtgtttacttgttctttgttggcattttcgatataaaataccgagggcagtatcagaagtatgccttgctgtggatggagagcgtgcagtgccgcctcatggggttcctggccatgctgtccaccgaagtctctgttctgctactgacctacttgactttggagaagttcctggtcattgtcttccccttcagtaacattcgacctggaaaacggcagacctcagtcatcctcatttgcatctggatggcgggatttttaatagctgtaattccattttggaataaggattattttggaaacttttatgggaaaaatggagtatgtttcccactttattatgaccaaacagaagatattggaagcaaagggtattctcttggaattttcctaggtgtgaacttgctggcttttctcatcattgtgttttcctatattactatgttctgttccattcaaaaaaccgccttgcagaccacagaagtaaggaattgttttggaagagaggtggctgttgcaaatcgtttcttttttatagtgttctctgatgccatctgctggattcctgtatttgtagttaaaatcctttccctcttccgggtggaaataccagacacaatgacttcctggatagtgatttttttccttccagttaacagtgctttgaatccaatcctctatactctcacaaccaacttttttaaggacaagttgaaacagctgctgcacaaacatcagaggaaatcaattttcaaaattaaaaaaaaaagtttatctacatccattgtgtggatagaggactcctcttccctgaaacttggggttttgaacaaaataacacttggagacagtataatgaaaccagtttcctagcaatcattttggatcactggactttcagtggactacctaaaacaggggacagcttttggaagatgacatctgcaatgcttttcatctttaccaacggcaagcctttctgcacagagagcacagcagaatggctcctgtcactgcattccaatggcagctgtactatctaccaaccatgctgaggacagcaccaaaggttcctctcctcaccccacatgcctgaaaagcacatgtgaattcgtgtatagtgggctgaggtgcagctgatctctagctaatcaacacaacccaccaacaaatgaccacaggttggcactgtgtggtctttcacatcgggttgcactgtccatgaaatagaaacactcacaacatctgattccagtgtggccataataacagaaatctaacaactctttccttgccttttcaatatcaaataaaaccatcagcatcctgctggattgata

SEQ ID NO: 175010 - DNA, 1852 bp, Homo sapiens
  Payload ID: 14362
  Gene Symbol: RXFP3
  Gene Name: relaxin/insulin-like family peptide receptor 3
  Uniprot ID: Q9NSD7
  ENST ID: ENST00000330120
  CDS Start-End: 356-1765
ggggagttatgcgccagtgccccagtgaccgcgggacacggagaggggaagtctgcgttgtacataaggacctagggactccgagcttggcctgagaacccttggacgccgagtgcttgccttacgggctgcactcctcaactctgctccaaagcagccgctgagctcaactcctgcgtccagggcgttcgctgcgcgccaggacgcgcttagtacccagttcctgggctctctcttcagtagctgctttgaaagctcccacgcacgtcccgcaggctagcctggcaacaaaactggggtaaaccgtgttatcttaggtcttgtcccccagaacatgacctagaggtacctgcgcatgcagatggccgatgcagccacgatagccaccatgaataaggcagcaggcggggacaagctagcagaactcttcagtctggtcccggaccttctggaggcggccaacacgagtggtaacgcgtcgctgcagcttccggacttgtggtgggagctggggctggagttgccggacggcgcgccgccaggacatcccccgggcagcggcggggcagagagcgcggacacagaggcccgggtgcggattctcatcagcgtggtgtactgggtggtgtgcgccctggggttggcgggcaacctgctggttctctacctgatgaagagcatgcagggctggcgcaagtcctctatcaacctcttcgtcaccaacctggcgctgacggactttcagtttgtgctcaccctgcccttctgggcggtggagaacgctcttgacttcaaatggcccttcggcaaggccatgtgtaagatcgtgtccatggtgacgtccatgaacatgtacgccagcgtgttcttcctcactgccatgagtgtgacgcgctaccattcggtggcctcggctctgaagagccaccggacccgaggacacggccggggcgactgctgcggccggagcctgggggacagctgctgcttctcggccaaggcgctgtgtgtgtggatctgggctttggccgcgctggcctcgctgcccagtgccattttctccaccacggtcaaggtgatgggcgaggagctgtgcctggtgcgtttcccggacaagttgctgggccgcgacaggcagttctggctgggcctctaccactcgcagaaggtgctgctgggcttcgtgctgccgctgggcatcattatcttgtgctacctgctgctggtgcgcttcatcgccgaccgccgcgcggcggggaccaaaggaggggccgcggtagccggaggacgcccgaccggagccagcgcccggagactgtcgaaggtcaccaaatcagtgaccatcgttgtcctgtccttcttcctgtgttggctgcccaaccaggcgctcaccacctggagcatcctcatcaagttcaacgcggtgcccttcagccaggagtatttcctgtgccaggtatacgcgttccctgtgagcgtgtgcctagcgcactccaacagctgcctcaaccccgtcctctactgcctcgtgcgccgcgagttccgcaaggcgctcaagagcctgctgtggcgcatcgcgtctccttcgatcaccagcatgcgccccttcaccgccactaccaagccggagcacgaggatcaggggctgcaggccccggcgccgccccacgcggccgcggagccggacctgctctactacccacctggcgtcgtggtctacagcggggggcgctacgacctgctgcccagcagctctgcctactgacgcaggcctcaggcccagggcgcgccgtcggggcaaggtggccttccccgggcggtaaagaggtgaaaggatgaaggagggctgggg

SEQ ID NO: 175011 - DNA, 1852 bp, Homo sapiens; identical to SEQ ID NO: 175010
  Payload ID: 14362
  Gene Symbol: RXFP3
  Gene Name: relaxin/insulin-like family peptide receptor 3
  Uniprot ID: Q9NSD7
  ENST ID: ENST00000616205
  CDS Start-End: 356-1765

SEQ ID NO: 175012 - DNA, 1240 bp, Homo sapiens
  Payload ID: 14363
  Gene Symbol: RXFP4
  Gene Name: relaxin/insulin-like family peptide receptor 4
  Uniprot ID: Q8TDU9
  ENST ID: ENST00000368318
  CDS Start-End: 1-1125
atgcccacactcaatacttctgcctctccacccacattcttctgggccaatgcctccggaggcagtgtgctgagtgctgatgatgctccgatgcctgtcaaattcctagccctgaggctcatggttgccctggcctatgggcttgtgggggccattggcttgctgggaaatttggcggtgctgtgggtactgagtaactgtgcccggagagcccctggcccaccttcagacaccttcgtcttcaacctggctctggcggacctgggactggcactcactctccccttttgggcagccgagtcggcactggactttcactggcccttcggaggtgccctctgcaagatggttctgacggccactgtcctcaacgtctatgccagcatcttcctcatcacagcgctgagcgttgctcgctactgggtggtggccatggctgcggggccaggcacccacctctcactcttctgggcccgaatagccaccctggcagtgtgggcggcggctgccctggtgacggtgcccacagctgtcttcggggtggagggtgaggtgtgtggtgtgcgcctttgcctgctgcgtttccccagcaggtactggctgggggcctaccagctgcagagggtggtgctggctttcatggtgcccttgggcgtcatcaccaccagctacctgctgctgctggccttcctgcagcggcggcaacggcggcggcaggacagcagggtcgtggcccgctctgtccgcatcctggtggcttccttcttcctctgctggtttcccaaccatgtggtcactctctggggtgtcctggtgaagtttgacctggtgccctggaacagtactttctatactatccagacgtatgtcttccctgtcactacttgcttggcacacagcaatagctgcctcaaccctgtgctgtactgtctcctgaggcgggagccccggcaggctctggcaggcaccttcagggatctgcggttgaggctgtggccccagggcggaggctgggtgcaacaggtggccctaaagcaggtaggcaggcggtgggtcgcaagcaacccccgggagagccgcccttctaccctgctcaccaacctggacagagggacacccgggtgaagggcgcaagctgaacacactcctctttctgagatccaccaagtgtaggatccttgagtcctggggagaagctgccctctctgccaggctgcagtgccctcagggaaaagtctga

SEQ ID NO: 175013 - DNA, 3535 bp, Homo sapiens
  Payload ID: 14364
  Gene Symbol: RELT
  Gene Name: RELT tumor necrosis factor receptor
  Uniprot ID: Q969Z4
  ENST ID: ENST00000064780
  CDS Start-End: 262-1554
agagcggcgagcccctccgcggctcggggtgagtcgggcgcggggcgcagaccgcgctctgacgtcgggggcggagcggccgtgacgcgcgggggcgggtctgcgcaccttcccggcccagccggcgattcattcaaaaggcgcgcaggctgcgcggctgtccgggcgctcgccgagccgggccgcggcgccgagtcgaacggggagccgagctggagctgccgcggcgcagccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgctgtcacgaggagctccttttctctgtgcccttcccagcttatccgcctgttccacttgtacctgtccagccctgccctgtgttgggcaccgtgacaggctgccctcccctcacagttcctgcacctcagcagccagggaagcagggcccagaggagacccatcaactcatctggttctcaccaaagcccctagctagaggcagggctgtcccacagaaatagtgtgagccacatatgtgactttaaattttctgacagtcacatttcaaaaagtaaaaagaagcaggtgaacttaatttttttttaacccagtctatccaaaatattttcatttcaatataaaatcagtataaaaagtgtgaatgagctgtttttgcttttgctttgaaatctggagtgtatcttacacatcttgattggaactcaaatatttcaagggctccatagccacgtggccagcagctaccacactggtcagcgcagcacctgaggaaatgcactgtgtggagcccgggaggtaattgggggtgaggaagatgtgcgggccagggaatgtgttccacagagagggacagcatgtgcaaaggctgagcaccaacacatagtggtcacctgggccttatgcccagggagcctccaaagcattcagctcctgcttggccagtgtggagaggaaaggagccacaggagcgggtgctacacccggcaagacagagcgtctccatctaaaattcctagggcaagcttccaacccggcccaagggccgcatgtggcccaggatatggctttgaatggggcctaacacaaattcataaactttcttaaaacatt

SEQ ID NO: 175014 - DNA, 2669 bp, Homo sapiens
  Payload ID: 14364
  Gene Symbol: RELT
  Gene Name: RELT tumor necrosis factor receptor
  Uniprot ID: Q969Z4
  ENST ID: ENST00000393580
  CDS Start-End: 228-1520
cgcgtcctgtcccggcgccttccgcgcaccggccaccgccagtctccgagccccgtgacctgcaggtcctccggccgcgactccgggccggccctgcgtggtggctgtcggggggcgcgcggggaagcagcggaacttgcggtgtgaggggccggcggggcccggagcggtccccggcccgggaaacttggaccgagaccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgc

SEQ ID NO: 175015 - DNA, 586 bp, Homo sapiens
  Payload ID: 14364
  Gene Symbol: RELT
  Gene Name: RELT tumor necrosis factor receptor
  ENST ID: ENST00000545687
  CDS Start-End: 283-586
aaaggcgcgcaggctgcgcggctgtccgggcgctcgccgagccgggccgcggcgccgagtcgaacggggagccgagctggagctgccgcggcgcagccagattcccaccagggcgaacccagcaccgcctgtataccagactctgtgccaggcactgaacgtaaataaaagccttaccacagccctctgcaggcaggccacagagccagtgcaagacagagcagagcaggactgcaccccatactttgtatccccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggg

SEQ ID NO: 175016 - DNA, 744 bp, Homo sapiens
  Payload ID: 14364
  Gene Symbol: RELT
  Gene Name: RELT tumor necrosis factor receptor
  ENST ID: ENST00000544075
  CDS Start-End: 118-429
gcaggctgcgcggctgtccgggcgctcgccgagccgggccgcggcgccgagtcgaacggggagccgagctggagctgccgcggcgcagccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagtgagtgggctggtgggagataacggggccaaaacctacattaaccagcctgcctcctggggatctcccacttgggtctccctcaagtcaccctgttccctgctggggtctcctgcccctggcctggcctatggccacttctgcctgtgccccctgcaggctgccgccagcgccccc

SEQ ID NO: 175017 - DNA, 1326 bp, Homo sapiens
  Payload ID: 14365
  Gene Symbol: RELL1
  Gene Name: RELT-like 1
  Uniprot ID: Q8IUW5
  ENST ID: ENST00000314117
  CDS Start-End: 90-905
actcgatcagcccgccggctccggagcggctctgccttcccgagcgcgggacgcggcgccctgggggaggagggcgaagcgacgcggcgatggctccgcgggcactcccggggtccgccgtcctagccgctgctgtcttcgtgggaggcgccgtgagttcgccgctggtggctccggacaatgggagcagccgcacattgcactccagaacagagacgaccccgtcgcccagcaacgatactgggaatggacacccagaatatattgcatacgcgcttgtccctgtgttctttatcatgggtctctttggcgtcctcatttgccacctgcttaagaagaaaggctatcgttgtacaacagaagcagagcaagatatcgaagaggaaaaggttgaaaagatagaattgaatgacagtgtgaatgaaaacagtgacactgttgggcaaatcgtccactacatcatgaaaaatgaagcgaatgctgatgtcttaaaggcgatggtagcagataacagcctgtatgatcctgaaagccccgtgacccccagcacaccagggagcccgccagtgagtcctgggcctttgtcaccaggggggacgccagggaagcacgtctgtggccatcatctgcatacggtgggcggtgttgtcgagagggatgtgtgtcatcggtgtaggcacaagcggtggcactttataaagcccactaacaagtccagagagagcagaccacggcgccaaggcgaggtcacggtcctttctgttggcagatttagagttacaaaagtggagcacaagtcaaaccagaaggaacggagaagcctgatgtctgttagtggggctgaaaccgtcaatggggaggtgccggcaacacctgtgaagagagaacgcagtggcacagagtagcagtgtcctgaatgacagctcatctacacagagtgaaactccagatatgtgacaagcagcatgggacagatgctgacaatcagaacagatgctggatgtaaacaactggtaaggctgcactggtgcatgctggcagaatcacctgctatgcatccagggagcaaatgcatctgcatgctcagcatgacaccagcttacctccctgtgcaaatcccctcccctaatcagtctcatccaaatcttctcctgcagtagcagcttctaaagctgcaagggcctccgccaccgctgcatcctcgtccacaatctccccatccccatctccatcggagccatgggtatcctcctgcctgtttcctgagtcaaccacaggcatggcatgaacaggacccttctcattaaagcagatgcttagaacttc

SEQ ID NO: 175018 - DNA, 1350 bp, Homo sapiens
  Payload ID: 14365
  Gene Symbol: RELL1
  Gene Name: RELT-like 1
  Uniprot ID: Q8IUW5
  ENST ID: ENST00000454158
  CDS Start-End: 90-905
actcgatcagcccgccggctccggagcggctctgccttcccgagcgcgggacgcggcgccctgggggaggagggcgaagcgacgcggcgatggctccgcgggcactcccggggtccgccgtcctagccgctgctgtcttcgtgggaggcgccgtgagttcgccgctggtggctccggacaatgggagcagccgcacattgcactccagaacagagacgaccccgtcgcccagcaacgatactgggaatggacacccagaatatattgcatacgcgcttgtccctgtgttctttatcatgggtctctttggcgtcctcatttgccacctgcttaagaagaaaggctatcgttgtacaacagaagcagagcaagatatcgaagaggaaaaggttgaaaagatagaattgaatgacagtgtgaatgaaaacagtgacactgttgggcaaatcgtccactacatcatgaaaaatgaagcgaatgctgatgtcttaaaggcgatggtagcagataacagcctgtatgatcctgaaagccccgtgacccccagcacaccagggagcccgccagtgagtcctgggcctttgtcaccaggggggacgccagggaagcacgtctgtggccatcatctgcatacggtgggcggtgttgtcgagagggatgtgtgtcatcggtgtaggcacaagcggtggcactttataaagcccactaacaagtccagagagagcagaccacggcgccaaggcgaggtcacggtcctttctgttggcagatttagagttacaaaagtggagcacaagtcaaaccagaaggaacggagaagcctgatgtctgttagtggggctgaaaccgtcaatggggaggtgccggcaacacctgtgaagagagaacgcagtggcacagagtagcagcaatgacttgacttgaagagctctaagagactgaaaacttatatgaagttgccttgggaatatttttatatattttatacagtttctatcatggagtcagcaggcacgtggataaaacctaaaagggaatattattgctgtgccatatacagaattcagtttgctttgaaacaagttttggttgaaagagtctgttgaaaattttattatacttccagggaaggaaagagctgtttttatcttcttaaccactcccagcctctactcttcccagcccctaatcccaggccttggtgtacacactgtagtttttccattatgatgagtatgtgcagtgatactattcatgtacagtctgagcttatgctcaggggtgtgtgtgtatatgtgtatgcatgtgtgcacgtgagtgtgtgtttctttttccagttcctgcatccta

SEQ ID NO: 175019 - DNA, 771 bp, Homo sapiens
  Payload ID: 14365
  Gene Symbol: RELL1
  Gene Name: RELT-like 1
  ENST ID: ENST00000512114
  CDS Start-End: 29-771
tgcaaactggaaacttctgttgatttcgatgaacccaggagcatgctggtatatttacatccttcagaaaggacttacccaacaagggggtgaagcagtggggtgtatcagttgtccagctctgaaaagaatctacttatttatgtttgtaaaaactgttggcatttggcaaatggggtacaatgggagcagccgcacattgcactccagaacagagacgaccccgtcgcccagcaacgatactgggaatggacacccagaatatattgcatacgcgcttgtccctgtgttctttatcatgggtctctttggcgtcctcatttgccacctgcttaagaagaaaggctatcgttgtacaacagaagcagagcaagatatcgaagaggaaaaggttgaaaagatagaattgaatgacagtgtgaatgaaaacagtgacactgttgggcaaatcgtccactacatcatgaaaaatgaagcgaatgctgatgtcttaaaggcgatggtagcagataacagcctgtatgatcctgaaagccccgtgacccccagcacaccagggagcccgccagtgagtcctgggcctttgtcaccaggggggacgccagggaagcacgtctgtggccatcatctgcatacggtgggcggtgttgtcgagagggatgtgtgtcatcggtgtaggcacaagcggtggcactttataaagcccactaacaagtccagagagagcagaccacggcgccaaggcgaggtcacggtcctttctgttggcag

SEQ ID NO: 175020 - DNA, 2520 bp, Homo sapiens
  Payload ID: 14366
  Gene Symbol: RELL2
  Gene Name: RELT-like 2
  Uniprot ID: Q8NC24
  ENST ID: ENST00000297164
  CDS Start-End: 1201-2112
agcatagctcctaggatgcgagggccatttgtctccggccgggggtcagatcctcgggaagccgagccatcccatccagccgcttgccccaaaccgggcgcaggccgtggtcacttctctaggaagctccgaagatcccgccactccgtccctcaaaggtgcggaaagccggcttcccccagccctcggagaagattcctgactctccgctcggtcggggcatctgagggcaggagctgcgccaggcgtaccggatagaccagtggacaacacccacgccggaccgcctgtcccctacccggacccagactcggcgccgcacattgccccgggggggcccggcgcagtcacgcgcgcgcagagctcacgctctccgccccgcacacctgcgctccgccccctggtcctgggcccgcgacgggtgaaggcatttgggaagccagggcggctgcggaggcgatctccctgacccagggccggagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccggtaccgggtcggccaggtggtcagggtgggagaaaccaaaaagggagaggggtgcgggagtactgagaggaaggggctgcagaggcctggctcaggccggcgtggaggaggtgcgggcgctgactcaggcaggatttctgctcccgccgcctaagaatgccgtcccatctcgtgctgcagtgtccttgggagggacagaagcgcgaacaagctggaaaggggaacgctcggggcgtcggggaagcgggaccagggtcgtggtagagagcttgcgttgccgctgacctcttgccgaaaggcgaaacagcactcctggcccggacagctccctggttgggtagggggtggggccggacctcagccggacgtcttagacgtgcttgtttcagatcctgaggacggcattcctacccctcccccattcccagctgcagccccctaaacccaggaggcgccctggcccgcgctcgccccccagggcctcatgtcggaaccacagcctgacctggaaccgccccaacatgggctatatatgctcttcctgcttgtgctggtcttcttcctcatgggcctggtaggcttcatgatctgccacgtgctcaagaagaagggctaccgctgccgcacgtcgaggggctctgagcctgacgatgcccagcttcagccccctgaggacgatgacatgaatgaggacacagtagagaggattgttcgctgcatcatccagaatgaagccaatgctgaggccttgaaggagatgctgggggacagtgaaggagaagggacagtgcagctgtccagtgtggatgccacctccagcctgcaggacggagccccctcccatcatcacacagtgcacctgggctctgcagccccttgcctccattgcagccgcagcaagaggcctccacttgtccgtcagggacgctccaaggaaggaaaaagccgcccccggacaggggagaccactgtgttctctgtgggcaggttccgggtgacacacattgagaagcgctatggactgcacgaacaccgtgatggctcccccacagacaggagctggggctctggtgggggacaggacccagggggtggtcaggggtctgggggagggcagcccaaggcagggatgcctgccatggagaggctgccccctgagaggccacagccccaggtcctagccagccccccagtacagaatggaggactcagggacagcagcctaacccctcgtgcacttgaagggaaccccagagcttctgcagagccaacactgagggccggagggaggggcccaagcccagggctgcccactcaagaggcaaatgggcagccaagcaaaccagacacttctgatcaccaggtgtctctaccacagggagcagggagtatgtgagtctccttcattgtgctgatggactaccagctggcagggccagggggtgggtgggcgtgaaagccctcccctccactggacagcactgccccccagctgagggaccagctctacttccacctggagttgcacagtctcaggctgggggcctcaggagaggtcacagcccctcagtctcttctccttcccctgcctgcaacaggctgcctgccccgccttccccaacacctcgctccatatgatagagcgtggcagctgggagcaggcccctgcccgtggtgggcccctaaagcaatagcaccgtaggccccctgccctcttagcacaagaggcccaggccctggcctggccttcgtgccctttattcattgtcaataaatccgctcagaccattacagctgcttcgca

SEQ ID NO: 175021 - DNA, 2154 bp, Homo sapiens
  Payload ID: 14366
  Gene Symbol: RELL2
  Gene Name: RELT-like 2
  Uniprot ID: Q8NC24
  ENST ID: ENST00000444782
  CDS Start-End: 849-1760
gagctccgcccctcgcccggctcagctctcccggtatctggggctttgagcgtcccgggttgggcagggaactggcagcatagctcctaggatgcgagggccatttgtctccggccgggggtcagatcctcgggaagccgagccatcccatccagccgcttgccccaaaccgggcgcaggccgtggtcacttctctaggaagctccgaagatcccgccactccgtccctcaaaggtgcggaaagccggcttcccccagccctcggagaagattcctgactctccgctcggtcggggcatctgagggcaggagctgcgccaggcgtaccggatagaccagtggacaacacccacgccggaccgcctgtcccctacccggacccagactcggcgccgcacattgccccgggggggcccggcgcagtcacgcgcgcgcagagctcacgctctccgccccgcacacctgcgctccgccccctggtcctgggcccgcgacgggtgaaggcatttgggaagccagggcggctgcggaggcgatctccctgacccagggccggagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccgctgcagccccctaaacccaggaggcgccctggcccgcgctcgccccccagggcctcatgtcggaaccacagcctgacctggaaccgccccaacatgggctatatatgctcttcctgcttgtgctggtcttcttcctcatgggcctggtaggcttcatgatctgccacgtgctcaagaagaagggctaccgctgccgcacgtcgaggggctctgagcctgacgatgcccagcttcagccccctgaggacgatgacatgaatgaggacacagtagagaggattgttcgctgcatcatccagaatgaagccaatgctgaggccttgaaggagatgctgggggacagtgaaggagaagggacagtgcagctgtccagtgtggatgccacctccagcctgcaggacggagccccctcccatcatcacacagtgcacctgggctctgcagccccttgcctccattgcagccgcagcaagaggcctccacttgtccgtcagggacgctccaaggaaggaaaaagccgcccccggacaggggagaccactgtgttctctgtgggcaggttccgggtgacacacattgagaagcgctatggactgcacgaacaccgtgatggctcccccacagacaggagctggggctctggtgggggacaggacccagggggtggtcaggggtctgggggagggcagcccaaggcagggatgcctgccatggagaggctgccccctgagaggccacagccccaggtcctagccagccccccagtacagaatggaggactcagggacagcagcctaacccctcgtgcacttgaagggaaccccagagcttctgcagagccaacactgagggccggagggaggggcccaagcccagggctgcccactcaagaggcaaatgggcagccaagcaaaccagacacttctgatcaccaggtgtctctaccacagggagcagggagtatgtgagtctccttcattgtgctgatggactaccagctggcagggccagggggtgggtgggcgtgaaagccctcccctccactggacagcactgccccccagctgagggaccagctctacttccacctggagttgcacagtctcaggctgggggcctcaggagaggtcacagcccctcagtctcttctccttcccctgcctgcaacaggctgcctgccccgccttccccaacacctcgctccatatgatagagcgtggcagctgggagcaggcccctgcccgtggtgggcccctaaagcaatagcaccgtaggccccctgccctcttagcacaagaggcccaggccctggcctggccttcgtgccctttattcattgtcaataaatccgctcagaccatt

SEQ ID NO: 175022 - DNA, 1419 bp, Homo sapiens
  Payload ID: 14366
  Gene Symbol: RELL2
  Gene Name: RELT-like 2
  ENST ID: ENST00000518856
  CDS Start-End: 322-1035
gacgggtgaaggcatttgggaagccagggcggctgcggaggcgatctccctgacccagggccggagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccggtaccggctgaggacgatgacatgaatgaggacacagtagagaggattgttcgctgcatcatccagaatgaagccaatgctgaggccttgaaggagatgctgggggacagtgaaggagaagggacagtgcagctgtccagtgtggatgccacctccagcctgcaggacggagccccctcccatcatcacacagtgcacctgggctctgcagccccttgcctccattgcagccgcagcaagaggcctccacttgtccgtcagggacgctccaaggaaggaaaaagccgcccccggacaggggagaccactgtgttctctgtgggcaggttccgggtgacacacattgagaagcgctatggactgcacgaacaccgtgatggctcccccacagacaggagctggggctctggtgggggacaggacccagggggtggtcaggggtctgggggagggcagcccaaggcagggatgcctgccatggagaggctgccccctgagaggccacagccccaggtcctagccagccccccagtacagaatggaggactcagggacagcagcctaacccctcgtgcacttgaagggaaccccagagcttctgcagagccaacactgagggccggagggaggggcccaagcccagggctgcccactcaagaggcaaatgggcagccaagcaaaccagacacttctgatcaccaggtgtctctaccacagggagcagggagtatgtgagtctccttcattgtgctgatggactaccagctggcagggccagggggtgggtgggcgtgaaagccctcccctccactggacagcactgccccccagctgagggaccagctctacttccacctggagttgcacagtctcaggctgggggcctcaggagaggtcacagcccctcagtctcttctccttcccctgcctgcaacaggctgcctgccccgccttccccaacacctcgctccatatgatagagcgtggcagctgggagcaggcccctgcccgtggtgggcccctaaagcaatagcaccgtaggccccctgccctcttagcacaagaggcccaggccctggcctggccttcgtgccctttattcattgtcaataaatccgc

SEQ ID NO: 175023 - DNA, 1780 bp, Homo sapiens
  Payload ID: 14366
  Gene Symbol: RELL2
  Gene Name: RELT-like 2
  ENST ID: ENST00000521367
  CDS Start-End: 752-1450
ggcagggaactggcagcatagctcctaggatgcgagggccatttgtctccggccgggggtcagatcctcgggaagccgagccatcccatccagccgcttgccccaaaccgggcgcaggccgtggtcacttctctaggaagctccgaagatcccgccactccgtccctcaaaggtgcggaaagccggcttcccccagccctcggagaagattcctgactctccgctcggtcggggcatctgagggcaggagctgcgccaggcgtaccggatagaccagtggacaacacccacgccggaccgcctgtcccctacccggacccagactcggcgccgcacattgccccgggggggcccggcgcagtcacgcgcgcgcagagctcacgctctccgccccgcacacctgcgctccgccccctggtcctgggcccgcgacgggtgaaggcatttgggaagccagggcggctgcggaggcgatctccctgacccagggccggagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccggtaccggctgaggacgatgacatgaatgaggacacagtagagaggattgttcgctgcatcatccagaatgaagccaatgctgaggccttgaaggagatgctgggggacagtgaaggagaagggacagtgcagctgtccagtgtggatgccacctccagcctgcaggacggagccccctcccatcatcacacagtgcacctgggctctgcagccccttgcctccattgcagccgcagcaagaggcctccacttgtccgtcagggacgctccaaggaaggaaaaagccgcccccggacaggggagaccactgtgttctctgtgggcaggttccgggtgacacacattgagaagcgctatggactgcacgaacaccgtgatggctcccccacagacaggagctggggctctggtgggggacaggacccagggggtggtcaggggtctgggggagggcagcccaaggcagggatgcctgccatggagaggctgccccctgagaggccacagccccaggtcctagccagccccccagtacagaatggaggactcagggacagcagcctaacccctcgtgcacttgaagggaaccccagagcttctgcagagccaacactgagggccggagggaggggcccaagcccagggctgcccactcaagaggcaaatgggcagccaagcaaaccagacacttctgatcaccagtctccttcattgtgctgatggactaccagctggcagggccagggggtgggtgggcgtgaaagccctcccctccactggacagcactgccccccagctgagggaccagctctacttccacctggagttgcacagtctcaggctgggggcctcaggagaggtcacagcccctcagtctcttctccttcccctgcctgcaacaggctgcctgccccgccttccccaacacctcgctccatatgatagagcgtggcagctgggagcaggcccctgcccgtggtgggcccctaaagcaatagcaccgtaggccccctgccctcttagcacaagaggcccaggccctggcctgg

SEQ ID NO: 175024 - DNA, 1545 bp, Homo sapiens
  Payload ID: 14367
  Gene Symbol: RSG1
  Gene Name: REM2 and RAB-like small GTPase 1
  Uniprot ID: Q9BU20
  ENST ID: ENST00000375599
  CDS Start-End: 421-1197
gcggacgcaggcggggcggaagtgggcccggcgggctggggcggcgggagtgcgggtgggcgtttaaaggggccttcggcacccaggtcggttcgccgccgggactgctgacggggagggctaggtagccctgggagtcgggatctagaaggtagaggagaagcggggctgtctgacccccggaggtgacaaggggagaggggctgtgtgaataccctccatgggcagtaatgggatgactatccccagggagcattgcgaaggagagaggcggctgagggactgcactttctggggccccccgggagagtcagagggcagttaagagggatcacaggcccggcttggtactgtcactccccttcccactccctgctctcagcattctgtcacctccctaccccgtcgcggtgcccagccatggccagacctcccgtgcccggttcggtggttgtcccaaactggcacgagagtgccgagggcaaggagtacctggcttgcattctgcgcaagaaccgccggcgggtgtttgggctgcttgagcggccagtgctgctgccgcctgtgtccattgacactgccagctacaagatctttgtgtccgggaagagtggtgtgggcaagacggcgctggtggccaagctggctggcctggaggtgcctgtggtgcaccacgagaccaccggcatccagaccaccgtggtattttggccagccaagctgcaggccagcagccgtgtcgtcatgtttcgttttgagttctgggactgtggagagtctgcactcaaaaagttcgatcatatgctgctggcttgcatggagaacacagatgccttcctcttcctcttctccttcactgaccgtgcctcctttgaagacctccctggacagctggcccgcatagcaggtgaggcccctggtgtcgtcaggatggtcatcggctccaaatttgaccagtacatgcacacggacgtgcccgagcgggacctcacagccttccggcaggcctgggagctgcccctgctacgggtgaagagtgtgccggggcggcggctggctgatgggcgcacactggacgggcgggctgggctggccgacgttgcccacatactcaatggccttgctgagcagctgtggcaccaggaccaggtggcggctggcctgcttcccaaccccccagagagtgctcctgaatgagtcacgagtggttgcctgtgatcccacccccaaccctcaggtctcgacatagggctggaggctggggcaggaacatggatcctatctggaggactggccagcatggcctgatcagggaggatgtggccagagaaggcccacccgcgagcagcgctttccttgcagaattcatggcagggaggtggggaccaaggccctgagctcgaacatctcccgtggcctttccccctttggcagcaccgatggaggatgactgggagagggggtgcctctcaagttacttcaatcaagaacctgtattggttgaggtgacaccatctgttgtaacagataaaccccgaaatccca

SEQ ID NO: 175025 - DNA, 336 bp, Homo sapiens
  Payload ID: 14367
  Gene Symbol: RSG1
  Gene Name: REM2 and RAB-like small GTPase 1
  ENST ID: ENST00000434014
  CDS Start-End: 1-336
tctgcgcaagaaccgccggcgggtgtttgggctgcttgagcggccagtgctgctgccgcctgtgtccattgacactgccagctacaagatctttgtgtccgggaagagtggtgtgggcaagacggcgctggtggccaagctggctggcctggaggtgcctgtggtgcaccacgagaccaccggcttgcatggagaacacagatgccttcctcttcctcttctccttcactgaccgtgcctcctttgaagacctccctggacagctggcccgcatagcaggtgaggcccctggtgtcgtcaggatggtcatcggctccaaatttgaccagtacatgc

SEQ ID NO: 175026 - DNA, 11550 bp, Homo sapiens
  Payload ID: 14368
  Gene Symbol: RSF1
  Gene Name: remodeling and spacing factor 1
  Uniprot ID: Q96T23
  ENST ID: ENST00000308488
  CDS Start-End: 304-4629
ttgttttcattccccctgtcacacgaggcagtggcaagcccgaaggggaggagagaagggggcggaaagagggcggaaagtgaaaggcgccgagggccgctctgtctcccgtctgactcggttctcgactgctccgggccgccgatgtattgtgggatcgcggagccgtccctgagacgctgggatccgcagaggagcccacttgagagcgcctcctgtcgtctgtaaggttgccttgccatccctcggcaccacaacttcccccgcccccccatcgcctcctcctccatcctccagttcaaaatggcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcatttgtacagtaaaatgtataatgaagctttgccaaccagactgtgctagcaacaaatttttttaaataagctttatgcagtggtaataaggtggcctcaaatatattgtgtctgatggagagttattagtgaaatgaatgtggtctttcttaaggcctgggtggactgtaaactttgccaatagtataactcttgtcttctggccacttgatgtttaaatatctgaaatatcattttgaaaaaaatacatctatatataacatacatgaagagatgctaagctgacagtgatattttagcacatttgaagactgggaagagattttcaggtgaattttaactggtctattcttgcccttagtatctacttcaaattgaagtctacaaacaaagcagttcctttgggaggtttttagtttgagttttagcgtgtgtgtgtgtttgtgtgtgtgcgtgtgcgtgtgtgtgtgtgttggaatttcctatctgcctggatatattagcagagtttgaatgtagttttggcctttggccattagacttctattaaaattcattaatagtcatacaaccaacatagagttgaatgagaactgccgatgtaattaataggcatgacatccatttcaaacatctcaacactttaaagaaaagccctttgtttcaagaaaaaagggtttgtaactaactaaatacctaacatgtaattgacactaaaatatgaactttgtcttatttagtttctgttatagctgtaaaatttcaggcagagccataacattgtacagagtgtagcacttgtgattaaacctagcctgttaaatcctgaaaccttcaaccattacttctgtgaatactttagccctgggatttgggtttttctgttccggtgttgtgtctgttgccggcaatggacacaccatatctgctgctggcccaaggaacgtcattaatttttctttccaaattaagtattatgtgctagtcagtgtatagtaaagcacttctcttttttattactaaaaagctggcattagatttgcattataaatacctctctaggaactttatactccttttccttcttcaacaggtattgcccttaaatcttatcttttggccttgaaagtttatagctattgtttttcagttgttcgttgttttgttttgtttcactttagttctgtagtacctgcccattaatatttttgctttgattctagcaatgtgtatgtatctgtataaaaaataaaataatgaaagcaacctaaaaataggatgcaccaatagcatgtggttccaagtaagttgtgatttttattttgagacagtgttccactggaagggagggaagggcttacattcacagacagtaaagcagggctgtgtaaggagctacatttacttaacagtctcctttccagctaggtttgttttatttatttgcaagtcagctaagaattaaccttttaaaccatctaaaacaggcaagcaatataaagatttctactagtgcaaggtaagtggtttgaatatacaagtgccctttcctgccacccagtctcactaccgttttagtcctgcagctgggtaaagccactattgtgtggaaactctcccatgtgccctgtctctacctctggacacaccagctccttcttccacctattctattcctcagttaagccaagtgatcagaagtagtattaaatgggtagataattttaacaggatgcctaatgtgaaataaggagttatttttactcttctactatagaaagcctaaggtaattcttaccatctcaaagactgagtattccatttaggtttggagaccacttgtgctgtgctgcctgatatttaccaaacttgaataagtgttcgtcaacttgatagtgaatgtaccccttctcaccttatattttgattaaatcaattaactataggtcatctaccaagaatgtaatccaagcggttgataaaacattattaggcagatagattattgattattaaattttgagcagtgcaaaaacggttttgctgcttggagttcagattcagtccctcaaagagtttatgatcactgaaatacactctgaaggtattctgaagaagttaaaaaattttagaaaacgaaatgttctgtatacaaagacaatacagtcactacgaactgcagaaagtataggaaagcagtaattgatgtagagtttagacagtcttggatcttttttagagcactaaccatggatttagactcaaaatagctgctacataatagagccctttaataatttaaaccccccttgttgaaatacaagttggactcccagtgtcaaactctagactgtagctaatgtattaaagggagatgtagattaatattcagtatatttagtttgcaatttctgaaaaggtttgaaaactagtcagcttttcacacagcagaagctttgaactgaaatatgtgtgaaaaggacgcagactgaaaacgttttggttttgtacatcagtgctgatgaaattagtgtaaaacattttccatcattggcacattactgcaaaatgatggcagagatattttcaagaatgtacatcaagttatatttccttgacatccttttttcaattggtcaaggttacagattcagaggataaagggtagtttcatttagaataaattcatgtctactggcaatctatatataaaagtgacctgcccaagaaccaaaaactttaaatgctaatgaagcttttgaaaaataatttttaaacaaattaattttaaaagggtgttacacgtacccagtttttactttttagttgatgaaacccatcctataatatacatttgagcaaagtacacatattaagaaaaacatggacatttacttgtttaatagtcaaaatgatgaggaaatgttagctgtttttaagtgggactggtggggtgtcctttgtcacaaggaatgcttttttagcttgtttgtgggcataagagatgttaaccctttgctgattctaccacacaactgtaaagaacctaatgaatctacaagtttaatattcagaaaaagctaggaactccgctctttaccagtacagtggaacaggcccgttattcaaggtgatgcctcacagctatagaacaactattcaaagacccagagttaaatggtacatgtgtatatgtgtgtgtgtgtgtgcacacgcacacacttcagataagtatcagaaaaaataaaaatgaatccatcattaacttgaaagaaataagatggctgcattgcaacagatacaaatattatgaacatcatttaattacagaaaatctagacaacagtttctcctgatgtttgacattctcaaaatatattcctcattctcgaagaagcagagaatgccaaggctgcatatctgctgtaatctacctagccctcttctgcttaatatgatccattattgaatcttctcagattaaaatccattcctatatcatctacctttcccaaagtgtgtgcctgtaaacctaccttggaagtggcaagttaactgatttttttgtgtcatttttataccaatccttaaggtcaaagccttttgctatcaatgtatttaaactgagttgctatatgttcactaatttgttttcaaaatgttttgctccaacttaaattatcttttaacatcttttgagtgccaagaattgctaagtaactgtaatatgttgaagagagtaattgccaagcaagcagtcataagccaaaatgtaatgagcttagtatataaccactttagagtatacactcaccactttttgtattcattcatgcaaaccctcctggaagtcgattagaagaggatccaatttgtggaccttttttcctccttttggacacctgagcacaattttttttttcctttcatatttataccactttggaaaattcagtaaacccaattctggcacatcataatggtttcagttagtgaagatgtttattttaataactttaaaatatgactatcctatacataagttatataagagggcataacaatagatgagtagaaatttataaaatttcttggatattttgaatgagaaaaaaacatttttaaaggaattttgttttttccttttttggccaaaccggtacaagttagaaagtgtgctaaggactgaatacttgcctcgtgctttttgccactggatgatgtaagttaagaatggaattgttaatcctaagtatatattttcttgactttcatcagtttctaaagaaatctaatttaagtgttttgcggttttgtttgatctgtatttattgagttctggtcatagaccagcagcttgcacgtcatgctcatgaacagccagaacatagttattggggaacttcatggctcaaaaccttctgaatcatttaacttattttgtatgttgcaaaaaaaaaaaaaaagtttattttgcttgagagtcacctttttttaaaaaaaataactgtacagcttttaagggatgggaggtgggaaaataccctaaaataggatgtagattttttacaattgtgtttatgctagatcatctacaggtgcattatgtaattaaacctaaaattgtttaaaaatttgtgccatgtctttttcattctcctgccctttagcagaattggtgcatgtcaactgctatgtggacaagccttgaaattagagtaacaagccctgtctccaaagctttaaggtcactgcatgaaaattgcacacacacacacacacacacacacatctagcttatattagtaaatggattttcaggatcagaacagctacagtagcccagatttggctgttaacagcatattcttacagcacatgatttttgtgatgcctaactagggtattctcaatgttagtctggtgttctattctctttcaaagtagcttcttgagatggtatctgttgtagcttgcccaaacctgccatgaggttgtgtgtacactttgaaagggtatgtcctatgctaagatggtggtagagcagggcttgattttaatctattcatataaaagaaggaaaaaactagaattggtctatttggttattcagtggacttaattccacaggaatagttgtctgctgaagcgtggcagcaagagaagtcaaattcaagtttcagttccttccttattcactaagtattttgaaatcttgtagaacttctgattctagcacagtcttttacatggcacattttaccatggtatattcacagcttcgtttaaatgtcagtactttttcccatctgataattttgccattctaatttctcacctttgtagtacaagtgtattcttgaaaataattaaattcatctaagtgtgtcataatttcaatcaaagctatattcatgtgttgccagcgtcagttttttgctatcctcattcagaagggaagcctgcagatcatgagtttccatatgaagaatacaaattccacataaaaatttataaatggtatctttagaattttgatttaaagtaatagctggaattcagggactgatcagaatgcctcttgaattttccaacatgcttatatgaaatgctttattttcctatgcgttaaaaaaaatattcctggaataggttctcagaatgttttatttggtttctaggagatgagatttaaagcagaagctccaagattggcataaaactaactcttgaggtaatcaggaccatgctgttagtcaaatagaagctggagtgctctctgtcacataatgtactgcatgtgtgtgggggtgggggggcagggaagatcagaaaactggaaatgtaattctgataacacgcaaagtaaattgtgcattaaaagtatgggaattcttggtagcttaaagcttcaggggttaacttcagtgtatgaacacctagtgtgttagaattgcagtgcatagttgtttaaatacaatattccttgtaagtgacaaccaaaatatgttgtggctggtgccagtatttttgttaatgaaatgttcagtgtctcactacagtctgatcagaactcttggtgttataagccaggcctaaagccattttatagctattggcctaattgtgtaactttttctttcaaaatgttttattataatacttctgtcatttctttcacttaatatgtcaattgtcataataaaaatttaaatttgaattatttagcatga

SEQ ID NO: 175027 - DNA, 604 bp, Homo sapiens
  Payload ID: 14368
  Gene Symbol: RSF1
  Gene Name: remodeling and spacing factor 1
  ENST ID: ENST00000440064
  CDS Start-End: 1-604
ggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagact

SEQ ID NO: 175028 - DNA, 2409 bp, Homo sapiens
  Payload ID: 14368
  Gene Symbol: RSF1
  Gene Name: remodeling and spacing factor 1
  ENST ID: ENST00000526324
  CDS Start-End: 1-2409
gagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaa

SEQ ID NO: 175029 - DNA, 830 bp, Homo sapiens
  Payload ID: 14368
  Gene Symbol: RSF1
  Gene Name: remodeling and spacing factor 1
  ENST ID: ENST00000531026
  CDS Start-End: 1-830
gaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaa

SEQ ID NO: 175030 - DNA, 5318 bp, Homo sapiens
  Payload ID: 14368
  Gene Symbol: RSF1
  Gene Name: remodeling and spacing factor 1
  Uniprot ID: Q96T23
  ENST ID: ENST00000480887
  CDS Start-End: 1062-4631
ctggtttatcaacttgacgagaatcatttcaaaattttaggaaaaaaatttatgtctcagtaaaactttgtttagaattaggtttttcagtagcaaggataaggtgaagggattaaaaatgtacgtaaaattagtagtcaatgaattctggaatgcagtctgtataatcctattcagagattatgctatttactgaatatagctttggttgtgtttaaatctgcactagtattaggtgctccttaaaagttgaaaatatatagccaataaggtataaagaagaattgacagataaatctaaacagtttctttgtatagtactaacttctgaaatgttcagtggtggcatttgataaagtaagttgtaatatgatcacattgaggaatgttatataattattaaactcaatttttataaaaggcatcattttataaaagtatcataagaaagtgccaatgtttcaatgaataaattgaggcaacatgataccaacttagtgaaaaatatacaagaccagaaggaagtaacctaaaatattactagtgattgcctctgggtaataggatatgggctttttgtctttctatatttttcattttcccactgccgtgttcctggtacctcagtgaaatgaagtgctcagttcttttaacagttgtcagtttttaaaacaaatatagtcttctggaaatgttttaggtagcattttcaattttatgtttttaagccatctcttgaatttgaataaattatttgaactgcataaatatttgcaatccattgagaacaccaaaacaaaaagtaaaaagcagaaacctaaatttttctaaattttttttaatatctagaagttgtatctcaaagtttttgtaattttcttcattgtcagattttattttttactgtcaaatatccaatgacagaggccacctcttttaaaatagaaactttaaatggaaatatacattatactaagtcttatattttatagccttgaaagtttctattcatgtaattaagctttttctgatttttagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagc

SEQ ID NO: 175031 - DNA, 2107 bp, Homo sapiens
  Payload ID: 14368
  Gene Symbol: RSF1
  Gene Name: remodeling and spacing factor 1
  ENST ID: ENST00000528095
  CDS Start-End: 1-2107
gcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaa

SEQ ID NO: 175032 - DNA, 495 bp, Homo sapiens
  Payload ID: 14368
  Gene Symbol: RSF1
  Gene Name: remodeling and spacing factor 1
  ENST ID: ENST00000532556
  CDS Start-End: 1-495
agaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactctt

SEQ ID NO: 175033 - DNA, 1447 bp, Homo sapiens
  Payload ID: 14369
  Gene Symbol: RNLS
  Gene Name: renalase, FAD-dependent amine oxidase
  Uniprot ID: Q5VYX0
  ENST ID: ENST00000331772
  CDS Start-End: 24-1052
gcggatcgctgctccctctcgccatggcgcaggtgctgatcgtgggcgccgggatgacaggaagcttgtgcgctgcgctgctgaggaggcagacgtccggtcccttgtaccttgctgtgtgggacaaggctgaggactcagggggaagaatgactacagcctgcagtcctcataatcctcagtgcacagctgacttgggtgctcagtacatcacctgcactcctcattatgccaaaaaacaccaacgtttttatgatgaactgttagcctatggcgttttgaggcctctaagctcgcctattgaaggaatggtgatgaaagaaggagactgtaactttgtggcacctcaaggaatttcttcaattattaagcattacttgaaagaatcaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccaccttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttagtgcctatatccttattctctacatgtgtattgggtttttattttcacaattttctgttattgattattttgttttctattttgctaagaaaaattactggaaaattgttcttcacttattatcatttttcatgtggagtataaaatcaattttgtaattttgatagttacaacccatgctagaatggaaattcctcacaccttgcaccttccctacttttctgaattgctatgactactccttgttggaggaaaagtggtacttaaaaaataacaaacgactctctcaaaaaaattacattaaatcacaataacagtttgtgtgccaaaaacttgattatccttatgaaaatttcaattctgaataaagaataatcacattatcaaagccccatc

SEQ ID NO: 175034 - DNA, 3385 bp, Homo sapiens
  Payload ID: 14369
  Gene Symbol: RNLS
  Gene Name: renalase, FAD-dependent amine oxidase
  Uniprot ID: Q5VYX0
  ENST ID: ENST00000371947
  CDS Start-End: 1341-2288
ttggacttacgtatttctttttattcaagaactctatccaatatatacacattttccttttggcttttgtcatttgtgtctttaagactttgaataatgtttttaaataatattaactttaatctttcatacacctttcagaaatttactatttgtattttgttttgtgtattttgtaacacacaagttgtaaatgattatgtattttctgttcaattccatctttcatttttatgcttaaaaatgtcttcttagtcatatatgcccgtctacattttcttctagttcttttattagatatatctagtattaattcgtcacccatttgatacatggtaatttttttcatgatgtggacatgaagtaaatattctgatttttaaatgtttccattataattggctaccattgtcaattttcttattggttctgatacttattcggtttcttagttttccaggtaataatttatctgcaagtcagcgtaacttaattatttgttttttaatagttcagtattaccattgcctttgttgtttcattgagaacttccagtacaatgtcaggagggggaaaaaaacaacggcaatggcaccaatccttctcttgttgttcatctttatattccttagaacatacggaatgcgttctgacatagaacttattgaagagtaatttggaattttctgatgaatcaactgtctttaatctttacaagtttgaaaggtatacgttattgtttccatttcccagatggagaaattgaggttcaggaaggttacacaaagtcccaggtctaagaaaaatgtctcccagattccaaaagatgtttctattatgctaatagtggccgttcaagcattagaggaaaggttgcccgtggtatcgctggtaaattcttcttcccactttcaaatctagaatagtaaaacagcaaaaatcccaacaggcatgagagttatcgcagtagataggttaagctgcttctctgctgtggtcaacgtcagctctgttgcgaggcgggttctcccaacaatagcccacaccatttccaggcttttctgggcgaggggcagggcgcccggcccccaaagcgagaagacagacagccccggttctccgcagccccaggtttgctcctcaaggacggaggggcctctcagctccggccgcctcctttccgccccctgcaggccggccggaggaaagctcagggcccaggtcggcccagggagcacggaaccaaagagcgctagcgccggttcggccgcctttccagaaagcccgggccgaacggccccgccgcagagactcagcgcggatcgctgctccctctcgccatggcgcaggtgctgatcgtgggcgccgggatgacaggaagcttgtgcgctgcgctgctgaggaggcagacgtccggtcccttgtaccttgctgtgtgggacaaggctgaggactcagggggaagaatgactacagcctgcagtcctcataatcctcagtgcacagctgacttgggtgctcagtacatcacctgcactcctcattatgccaaaaaacaccaacgtttttatgatgaactgttagcctatggcgttttgaggcctctaagctcgcctattgaaggaatggtgatgaaagaaggagactgtaactttgtggcacctcaaggaatttcttcaattattaagcattacttgaaagaatcaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccaccttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggtaccaagtgctggtgtgattctaggatgtgcgaagagcccctggatgatggcgattggatttcccatctgacttcctggaaattggagcacacagtcaggttttatttgatttttttttttaaggataccacttcacagcctttaggatagctattatttagaagcaaaacagaagataaatgttggcaaggatgtggagatattggattcccttgtgcagtgccggtgggaatgtaaaatgatgtagctactatggaaaatgatacggcaatttctttagaaatgaaatatagaattgctgtatgatctgcagttccacatctggatatctatccaaaagaagtgaaagtagggacttgaacgaacatttgtacaccaatgttcacagcggctttattcacaacagccaaaaggtggaagcaacccagtgtccatggatagatgaatagataaataaaatgtggtataaacatacaatgggctattgtttagccttaaaagggaaggaaattctgacatgctgcaatatggatgaagcttaaagtcattatgcaaagtggaataagcctatcacaaaaaataatattacataattctacttatatgaggaatctagagcagtcagtttcacagagacagaaaatagaatggtggttgccaagggctgggagaagagggcaatggagagtgagtgtttagtgggtcagagttttagtttgggaaggtaaaaagttctggagatggatgatggttatgggtgctcaacagtgtgaatgtacttaatgccacagaactgcacatttaaatgtggttaaaatcatcacttttatgttatgtatatttaccacaataaataaagaagttgatatttcttatacttacaaagaggagaagggcatttgcaaatcaacaagaagtgtgaggcccctctctctagcagaaaaatagactaaatctatttctttatcttttaacatcctgtttaagggaaatgccaaaacaaatgggaaaaaatacacacacacaaatatatatgaacatgttttgcctcatgagtaatcaaaatgtgtacatatgtatgtttatgtatgtgtgtttatatttaaaatcgtgttctgccttatgagtaaacaaaaagtatacaaattaaaaactataatgaaacgt

SEQ ID NO: 175035 - DNA, 525 bp, Homo sapiens
  Payload ID: 14369
  Gene Symbol: RNLS
  Gene Name: renalase, FAD-dependent amine oxidase
  ENST ID: ENST00000437752
  CDS Start-End: 1-525
atggcgcaggtgctgatcgtgggcgccgggatgacaggaagcttgtgcgctgcgctgctgaggaggcagacgtccggtcccttgtaccttgctgtgtgggacaaggctgaggactcagggggaagaatgactacagcctgcagtcctcataatcctcagtgcacagctgacttgggtgctcagtacatcacctgcactcctcattatgccaaaaaacaccaacgtttttatgatgaactgttagcctatggcgttttgaggcctctaagctcgcctattgaaggaatggtgatgaaagaaggagactgtaactttgtggcacctcaaggaatttcttcaattattaagcattacttgaaagaatcaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccacc

SEQ ID NO: 175036 - DNA, 1447 bp, Homo sapiens
  Payload ID: 14370
  Gene Symbol: REN
  Gene Name: renin
  Uniprot ID: P00797
  ENST ID: ENST00000272190
  CDS Start-End: 30-1250
ctcagagagagccccagactgagggaagcatggatggatggagaaggatgcctcgctggggactgctgctgctgctctggggctcctgtacctttggtctcccgacagacaccaccacctttaaacggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattggcatcggcaccccaccccagaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacagagattccgagaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctgaggccctctgccacccaggcaggccctgccttcagccctggcccagagctggaacactctctgagatgcccctctgcctgggcttatgccctcagatggagacattggatgtggagctcctgctggatgcgtgccctgacccctgcaccagcccttccctgctttgaggacaaagagaataaagacttcatgttcaca

SEQ ID NO: 175037 - DNA, 1322 bp, Homo sapiens
  Payload ID: 14371
  Gene Symbol: RENBP
  Gene Name: renin binding protein
  ENST ID: ENST00000369997
  CDS Start-End: 78-1319
gggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccagtttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataaagg

SEQ ID NO: 175038 - DNA, 1388 bp, Homo sapiens
  Payload ID: 14371
  Gene Symbol: RENBP
  Gene Name: renin binding protein
  Uniprot ID: P51606
  ENST ID: ENST00000393700
  CDS Start-End: 82-1365
agccgggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccagtttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataaaggctgagtccgctccacctgcg

SEQ ID NO: 175039 - DNA, 1304 bp, Homo sapiens
  Payload ID: 14371
  Gene Symbol: RENBP
  Gene Name: renin binding protein
  ENST ID: ENST00000423624
  CDS Start-End: 17-199
tagaggagcaggagggatgagcaagggtctcccagcgcgacaggccagacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccagtttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataa

SEQ ID NO: 175040 - DNA, 817 bp, Homo sapiens
  Payload ID: 14371
  Gene Symbol: RENBP
  Gene Name: renin binding protein
  ENST ID: ENST00000442361
  CDS Start-End: 1-480
actttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccaggctggagcgcaatggcgtgatctcagctcactgcaacctccgcctcctgtgttcaagctattctcccgcctcagcctcccgagtatactgctgggattacaagtgcg

SEQ ID NO: 175041 - DNA, 745 bp, Homo sapiens
  Payload ID: 14371
  Gene Symbol: RENBP
  Gene Name: renin binding protein
  ENST ID: ENST00000457282
  CDS Start-End: 1-349
ggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccagggtctctatcgcccaggctgagtgcagtggcacaatcatggctcagtgcagcctcaacctcctgggctcaagcgatccttccacctcagccacccaggctggagcgcaatggcgtgatctcagctcactgcaacctccgcctcctgtgttcaagctattctcccgcctcagcctcccgagtatactgctgggattacaatttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataaaggctgagtcc

SEQ ID NO: 175042 - DNA, 376 bp, Homo sapiens
  Payload ID: 14371
  Gene Symbol: RENBP
  Gene Name: renin binding protein
  ENST ID: ENST00000451114
  CDS Start-End: 1-376
ctctggtggccacacagtgaagccatgattgccttcctcatgggttacagtgacagtggggaccctgtgctgctgcgcctcttctaccaagtggctgagtacaccttccgccaggctggagcgcaatggcgtgatctcagctcactgcaacctccgcctcctgtgttcaagctattctcccgcctcagcctcccgagtatactgctgggattacaatttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgccc

SEQ ID NO: 175043 - DNA, 3569 bp, Homo sapiens
  Payload ID: 14372
  Gene Symbol: RPTN
  Gene Name: repetin
  Uniprot ID: Q6XPR3
  ENST ID: ENST00000316073
  CDS Start-End: 66-2420
atcctctctgactcctgaatcttctgctccttcctcctcaagcaggttcacccgtacttgtcaaaatggctcaactcctgaatagcatactcagtgtgattgacgtattccacaaatatgccaaagggaatggggactgtgccttactatgcaaggaagagttgaaacaactgctcttggctgagtttggagacatcctccagagaccaaatgacccagagactgtggaaaccatcttgaacctcttagatcaagaccgagatggacatattgattttcatgagtacctcttgttggtgttccagttggtccaagcctgctatcataagctagacaataagtcacatggaggcaggacctcacagcaagaaagggggcaggaaggagcacaagactgtaagttcccaggaaacacaggcagacaacacagacagaggcacgaggaagaaaggcagaactcccaccacagtcagcctgagagacaagacggagattcccaccatggtcagcctgagagacaagacagagattcccaccatggtcagtctgagaaacaagacagagattcccaccacagtcagcctgagagacaagacagagattctcaccacaatcagtctgagagacaagacaaggatttcagctttgatcagtcagagagacaaagtcaagactccagctctggtaaaaaagtgagtcacaaatctaccagtggccaggctaaatggcagggacatatctttgccttaaatcggtgtgaaaaaccaattcaggattctcattatggtcagtctgaaagacatacacaacaatctgaaacacttggacaagcctctcactttaaccagacaaatcaacagaaatcaggctcttattgtggacagtctgagaggctaggtcaggaattaggctgtggtcagacagacagacaaggccagagttcccactacggtcagacggacagacaagaccagagttatcattatggtcagacagacagacaaggccagagttcccactacagtcagacggacagacaaggccagagttcccactacagtcagccagacagacaaggtcagagttcccactatggtcaaatggacagaaaaggccagtgttatcattatgatcagacaaacagacaaggccagggttcccactacagtcaaccaaacagacaaggtcagagttcccactatggtcagccagacacacaagatcagagttctcactatggtcagacagacagacaagaccaaagttctcactatggtcagacagagagacaaggccagagttcccactacagtcagatggaccgacaaggccagggttctcactacggtcagacagacagacaaggccagagttcccactatggtcagccagacagacaaggccagaattcccactatggtcagacagacagacaaggccagagttcccactatggtcagacagacagacaaggccagagttcccactacagtcagccagacaaacaaggccagagttcccactatggtaagatagacagacaagaccagagttatcattatggtcagccagacggacaaggccaaagttcccactatggtcagacagacagacaaggccagagtttccactatggtcagccagacagacaaggccagagttcccactacagtcagatggacagacaaggccagagttcccactatggtcagacagacagacaaggccagagttcccactacggtcagacagacagacaaggccagagctatcattatggtcagacagacagacaaggccagagttcccactatattcaatcacagactggggaaatacaagggcaaaataagtacttccaagggactgaaggaacaagaaaagcctcttatgttgaacaatcaggaagatcagggaggctaagtcaacagactccaggacaggaagggtaccaaaaccagggacagggattccagtctagggactcacagcagaacggccaccaggtatgggagcctgaagaggatagccaacatcaccaacacaaactcttagcacaaatccaacaagaaagaccactttgtcacaaagggagagactggcaatcatgcagtagtgagcagggccacagacaggcccagaccaggcagagtcatggtgaggggctgagccactgggcagaggaagagcagggccatcaaacttgggatagacacagccatgagagtcaggaaggtccatgtgggacacaggacaggcgaacccataaagatgagcagaaccatcagagacgagacagacaaacccatgaacatgagcagagccatcagagacgagacaggcaaacccatgaagacaagcagaaccgtcagagacgagacaggcaaacccatgaagacgagcagaaccatcagagatgagacaggcaaactcatgaagaggatcaaaaccatcagcaacaacataatagacaaaactatgaggagaaagagaggtatcaaggatctcagaatcaaaaatcccaagtgacccacagaagctgtcctaacagagaaaaattccacatgaaagaggatgaccagagccaaggctcacagaaaagacacactgaaccatccttctatccaacccagagcagtgggaggccccaaaccagagaacagcgtggtcaccctgccaagggagctactgttcccaaccccccctatgactatgtgcaagagcagaaatcctacccatactaggctatgtgagcaccagaggtaaagcaacacaaagccaaaaaagaaacctatatgtcgagttcacctttaattcgatttaagagattgagaatgtatttcttccctctatcctctgctgtatctccctgcaaggatgtttttgagtactagcattcacgtaagggcttttggttctttgagcagcaattctagggttttctgattcagtgaaatctaggtggtaaattgggtgaaataatcatatcttaatgttgatcagtttgggtatttaaatcatttcctgctttgccctctgtgtagatgagacctggttgaatcattgaaaggtagaacacttctccctaaagttcagaaacagaaaagatattctgaagatttacattacatccaaggattatactacatctccactcctcaaggaaccctagatttggtgagctttggctcctgtggataaaacatcaggaatttcaagcctcatagtctagactagaatgaaactcagttcaaggctgctacaagagccgagaacatagagtgcatctctgatgtttactacatctcccatgccaggctcttattccacaccagagggactgtccattagtgcctatcactagagctgaatggacccattccaattcaatacctttctagtttctgattatataaaataaagagaaagtatatgtcatatgtttgcaaattccaggggatcaagactattgattcatagctcctaagacctgaaaactcttctcaagaaaatctatgtgcagattatgaattgtattaaaatatctaataaataattgatgagcaata

SEQ ID NO: 175044 - DNA, 4859 bp, Homo sapiens
  Payload ID: 14373
  Gene Symbol: RFC1
  Gene Name: replication factor C (activator 1) 1, 145kDa
  Uniprot ID: P35251
  ENST ID: ENST00000349703
  CDS Start-End: 111-3554
cttgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactatggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 175045 - DNA, 4886 bp, Homo sapiens
  Payload ID: 14373
  Gene Symbol: RFC1
  Gene Name: replication factor C (activator 1) 1, 145kDa
  Uniprot ID: P35251
  ENST ID: ENST00000381897
  CDS Start-End: 135-3581
accgcgcgccactgtcttcgccttcttgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactatggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 175046 - DNA, 561 bp, Homo sapiens
  Payload ID: 14373
  Gene Symbol: RFC1
  Gene Name: replication factor C (activator 1) 1, 145kDa
  ENST ID: ENST00000504554
  CDS Start-End: 1-561
cctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatg

SEQ ID NO: 175047 - DNA, 841 bp, Homo sapiens
  Payload ID: 14373
  Gene Symbol: RFC1
  Gene Name: replication factor C (activator 1) 1, 145kDa
  ENST ID: ENST00000512275
  CDS Start-End: 99-491
gggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagaggagacaataaccggaataatacgggatgctgtacgtgaaagggccagacccagtgcctgacacattgagtagcagtccaaaggaaaaaataaaaagaaaaacaaagtccataggtgaactttgtaggttacgtgaaacatttgttgatgaaactgttcaaaatatcaaagacaaaaaatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagag

SEQ ID NO: 175048 - DNA, 504 bp, Homo sapiens
  Payload ID: 14373
  Gene Symbol: RFC1
  Gene Name: replication factor C (activator 1) 1, 145kDa
  ENST ID: ENST00000503784
  CDS Start-End: 109-504
tgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaactt

SEQ ID NO: 175049 - DNA, 584 bp, Homo sapiens
  Payload ID: 14373
  Gene Symbol: RFC1
  Gene Name: replication factor C (activator 1) 1, 145kDa
  ENST ID: ENST00000514572
  CDS Start-End: 1-304
tatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaaggtagtattttaagccacagacaggagaacctcaaaatagatgatctttccttgcctggtgaataatagggccttttcagcacatagcagaataacttgaaaatacttcttaagtttttttgttcatcatggttgagggtggagaaggtagagatttcatttttataaagtttcttatggtagtcgaagagccaaacagcaagaaaacaggccatgatattgacggccatatgttctgttagaaaaagtaccatttttatttatctagccattggtgtatgctttcaagaaaa

SEQ ID NO: 175050 - DNA, 1695 bp, Homo sapiens
  Payload ID: 14374
  Gene Symbol: RFC2
  Gene Name: replication factor C (activator 1) 2, 40kDa
  Uniprot ID: P35250
  ENST ID: ENST00000055077
  CDS Start-End: 62-1126
ggggcttgcgtggcggcgtcaaggggcggtgcctcgggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgcatgtttgcttctgggacgtctgtgccccgcaagtgtttgagtttggcctccaccccattgatgcggtgacggggcggaaaggcgcagagaagctgagggcggtctctgatctgtgtgtgggttgacat

SEQ ID NO: 175051 - DNA, 1576 bp, Homo sapiens
  Payload ID: 14374
  Gene Symbol: RFC2
  Gene Name: replication factor C (activator 1) 2, 40kDa
  Uniprot ID: P35250
  ENST ID: ENST00000352131
  CDS Start-End: 7-969
gcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgcatgtttgcttctgggacgtctgtgccccgcaagtgtttgagtttggcctccaccccattgatgcggtgacggggcggaaaggcgcagagaagctgagggcggtctctgatctgtgtgtgggttgacattttagctaataaagccttgcagtgtttgttggcaataa

SEQ ID NO: 175052 - DNA, 871 bp, Homo sapiens
  Payload ID: 14374
  Gene Symbol: RFC2
  Gene Name: replication factor C (activator 1) 2, 40kDa
  ENST ID: ENST00000480432
  CDS Start-End: 25-258
gtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaag

SEQ ID NO: 175053 - DNA, 847 bp, Homo sapiens
  Payload ID: 14374
  Gene Symbol: RFC2
  Gene Name: replication factor C (activator 1) 2, 40kDa
  ENST ID: ENST00000485545
  CDS Start-End: 1-361
ggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaaggttggcctccttccccccgtcctggcagaggaaccgctcacttcttgggcagaggagagcgggagcccttctgattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacc

SEQ ID NO: 175054 - DNA, 730 bp, Homo sapiens
  Payload ID: 14374
  Gene Symbol: RFC2
  Gene Name: replication factor C (activator 1) 2, 40kDa
  ENST ID: ENST00000494019
  CDS Start-End: 1-263
tctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaagg

SEQ ID NO: 175055 - DNA, 853 bp, Homo sapiens
  Payload ID: 14374
  Gene Symbol: RFC2
  Gene Name: replication factor C (activator 1) 2, 40kDa
  ENST ID: ENST00000463194
  CDS Start-End: 1-306
gcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcggggtcagaggtgacggagatgcaaacagcagtgaacataactcaagagctacctgaggtccttctggtggtttgaagtctttactggagatctcattcccagggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtg

SEQ ID NO: 175056 - DNA, 957 bp, Homo sapiens
  Payload ID: 14374
  Gene Symbol: RFC2
  Gene Name: replication factor C (activator 1) 2, 40kDa
  ENST ID: ENST00000479105
  CDS Start-End: 1-158
aggactctgaccctgcccctgccttcagcaaggcccccggcagcgccggccactacgaactgccgtgggttgaaaaatataggccagtaaagctgaatgaaattgtcgggaatgaagacaccgtgagcaggctagagtcatccagaagcaagttttaaccggttttaatgatcattttcgccgtaggtctttgcaagggaaggaaatgtgcccaacatcatcattgcggggtcagaggtgacggagatgcaaacagcagtgaacataactcaagagctacctgaggtccttctggtggtttgaagtctttactggagatctcattcccagggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaaggttggcctcctt

SEQ ID NO: 175057 - DNA, 753 bp, Homo sapiens
  Payload ID: 14374
  Gene Symbol: RFC2
  Gene Name: replication factor C (activator 1) 2, 40kDa
  ENST ID: ENST00000497430
  CDS Start-End: 1-595
catgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaactgccaaacggttttccgaagtggctgcagcacgtgcattcccaccagcattccggaggatcctcaacctagccaccacatggagtgctcagtttggtttttaagccattctaataggaaattggatacactcacatgaaaatagcggaaggagtgaactctcttttgcagatggcaggcctcctggcaaggctgtgtcagaagacaatggccccggtggccagttagag

SEQ ID NO: 175058 - DNA, 881 bp, Homo sapiens
  Payload ID: 14374
  Gene Symbol: RFC2
  Gene Name: replication factor C (activator 1) 2, 40kDa
  ENST ID: ENST00000470266
  CDS Start-End: 1-226
caaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcggggtcagaggtgacggagatgcaaacagcagtgaacataactcaagagctacctgaggtccttctggtggtttgaagtctttactggagatctcattcccagggccctccaggaaccggcaagaccacaagcattctgtgcttggcccgggccctgctgggcccagcactcaaagatgccatgttggaactcaatgcttcaaatgacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaagg

SEQ ID NO: 175059 - DNA, 782 bp, Homo sapiens
  Payload ID: 14374
  Gene Symbol: RFC2
  Gene Name: replication factor C (activator 1) 2, 40kDa
  ENST ID: ENST00000493156
  CDS Start-End: 7-120
gcgagaatggaggtggaggccgtctgtggtggcgcgggcgaggtggaggcccaggactctgaccctgcccctgccttcagcaaggcccccggcagcgccggccactacgaactgccgtgatggagtcacactttgtcacacaggctggagtgcagtggtgtgatttctgctcactacaacctgcatctccctggttcaatcaattctgcctcagccttcctagtagctgggattacagggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaag

SEQ ID NO: 175060 - DNA, 726 bp, Homo sapiens
  Payload ID: 14374
  Gene Symbol: RFC2
  Gene Name: replication factor C (activator 1) 2, 40kDa
  ENST ID: ENST00000491206
  CDS Start-End: 1-87
gaaaaatataggccagtaaagctgaatgaaattgtcgggaatgaagacaccgtgagcaggctagagtcatccagaagcaagttttaaccggttttaatgatcattttcgccgtaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaagga

SEQ ID NO: 175061 - DNA, 1635 bp, Homo sapiens
  Payload ID: 14374
  Gene Symbol: RFC2
  Gene Name: replication factor C (activator 1) 2, 40kDa
  ENST ID: ENST00000621097
  CDS Start-End: 278-1033
ggaagccagggggcggggcttgcgtggcggcgtcaaggggcggtgcctcgggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgcatgtttgcttctgggacgtctgtgccccgcaagtgtttgagtttggcctccaccccattgatgcggtgacggggcggaaaggcgcagagaagctgagggcggtctctgatctgtgtgtgggttgacattttagctaataaagccttgcagtgtttgttggc

SEQ ID NO: 175062 - DNA, 2402 bp, Homo sapiens
  Payload ID: 14375
  Gene Symbol: RFC3
  Gene Name: replication factor C (activator 1) 3, 38kDa
  Uniprot ID: P40938
  ENST ID: ENST00000380071
  CDS Start-End: 131-1201
tttacgcggccgcgaccggtagtgacgtcacgagatttggagctcgcgggaaaacttgtctctgcgttgtggggaggacgcgcgctcgcgcgggattttcaagcgtaggcccccgggaactcgagctgccatgagcctctgggtggacaagtatcggccctgctccttgggacggctggactatcacaaggagcaggcggcccagctgcggaacctggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacaactccatctaaaaaaaaaattgaaattagcaccattgcaagtaactaccaccttgaagttaatcctagtgatgctggaaatagtgaccgagtagtcattcaggagatgttgaaaacagtggcacaatcacaacaacttgaaacaaactctcaaagggattttaaagtggtattattgacagaagttgacaaactcaccaaagatgctcagcatgccttgcgaagaaccatggaaaaatatatgtctacctgcagattgatcttgtgctgcaattctacatctaaagtgatcccacctattcgtagtaggtgcttggcggttcgtgtgcctgctcccagcattgaagatatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacaatatccttttactgcagatcaagaaatccctgagacagattgggaggtgtatctgagggagactgcaaatgctattgtcagtcagcaaactccacaaaggctccttgaagttcgtggaaggctgtatgagcttctaactcattgtattcctcctgagataataatgaagggccttctctcagaactgttacataattgtgatggacaactgaaaggggaggtggcacaaatggcagcttactatgagcatcgtctacagctgggtagcaaagccatttatcacttggaagcgtttgtggccaaattcatggcactttataagaagttcatggaggatggattggaaggcatgatgttctgacttctgtcagttattcttgcaaagatttctcagtatcagtatttacatacagcttatattaaaagagctgtgggtaaattaactgaacttaatcatgtcgtatttgcgtttttttggtaataacttctctgtgaactattaatcatcctctgagttaaataattgctcctatactattgaagtatgtagttttgtacataacttagagactttagagtctaagaaaatgatcttaatttactttaagcattggttattcaagtattcattgttgatcctcctattctcttccgtctaatctctcacctgctaaaggagatttacacattagaaagcaaagattattttcatttatccagatgaccattttctgccacaggtaacatgattgtttgacacaccattatatttaattctagtttctctcaatgaataattgtatttttgtaggaaatgtaagatttcattctgaaacataattattggtatggacaaaattgcagataccatttctgttgaggctgcagatttccaacttttatttcagtggttcagattagtattaggtcggtactaagaaataagcatgttttcactaatttaagtacttgagactcttgaagaaaattcagaatgaagttctggagaaaggtatgttactgtagtaattactctttgaacaggttttgtgttttgtcattagctctgccctttttaattaaatattttggttcatggaccaaagggtttacttgacaaatttgtgtgacagactccgaacaattcctttactacgaagtataatttataaaataaaatatacccattttaagggtacagtttgatttttgaccagtgaaactatgatcccaatcaaggtatagatgccgtcaccccaaaaagttccctccatatccctttgcagtcagttcatccctaccctggcccagatgatcactgatcttgtcattatagatgagttttgccagttcaagaatttaatggaatcagatattgtaagcattcttgtgtaatacttcattctctctcattattgagattcatccatattgttgaatgtttcactagttaatgtttattgttcaatatttttgtatatacttttaaagcctattcacttgctgatggatctttggtttgtttccaggtttggttattatgaataaagttgctgtgaata

SEQ ID NO: 175063 - DNA, 1461 bp, Homo sapiens
  Payload ID: 14375
  Gene Symbol: RFC3
  Gene Name: replication factor C (activator 1) 3, 38kDa
  Uniprot ID: P40938
  ENST ID: ENST00000434425
  CDS Start-End: 111-1028
agtgacgtcacgagatttggagctcgcgggaaaacttgtctctgcgttgtggggaggacgcgcgctcgcgcgggattttcaagcgtaggcccccgggaactcgagctgccatgagcctctgggtggacaagtatcggccctgctccttgggacggctggactatcacaaggagcaggcggcccagctgcggaacctggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacaactccatctaaaaaaaaaattgaaattagcaccattgcaagtaactaccaccttgaagttaatcctagtgatgctggaaatagtgaccgagtagtcattcaggagatgttgaaaacagtggcacaatcacaacaacttgaaacaaactctcaaagggattttaaagtggtattattgacagaagttgacaaactcaccaaagatgctcagcatgccttgcgaagaaccatggaaaaatatatgtctacctgcagattgatcttgtgctgcaattctacatctaaagtgatcccacctattcgtagtaggtgcttggcggttcgtgtgcctgctcccagcattgaagatatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacaatatccttttactgcagatcaagaaatccctgagacagattgggaggtgtatctgagggagactgcaaatgctattgtcagtcagcaaactccacaaaggctccttgaagttcgtggaaggctgtatgagcttctaactcattgtattcctcctgagataataatgaaggcatgtaaggaggaatcaagaagctgtgacatattctgaggacctccaaagaacaacttgctactgactggacttctctcatcttttagcatgtgaagttttgcaaatataatccactttgctctgaatgtcctgacacctgcttcagagctcaagattcagactccagcctgaatgttatttcctgagaaaatccctccctgacccactgtgctggttaggtccacctgctaatcacatccacaaaaccctctgcttctccttcaaaacactcatctcctctgtaatgatcagatgaactcatgtctttctcagaggacaataaatttgatgaatggggaccatggaagtttatttccatctgtatccctacatctaactcatctgctggtacctatttgtcatgtatttaataagtacaactacctatgccaccctgcaataaaatgatattgttactttctcttcttta

SEQ ID NO: 175064 - DNA, 612 bp, Homo sapiens
  Payload ID: 14375
  Gene Symbol: RFC3
  Gene Name: replication factor C (activator 1) 3, 38kDa
  ENST ID: ENST00000616236
  CDS Start-End: 1-312
gaaggtctgaatcttccttcacaactggctcatagacttgcagagaagtcttgtagaaatctcagaaaagccctgcttatgtgtgaagcctgcagagtgcaacaatatccttttactgcagatcaagaaatccctgagacagattgggaggtgtatctgagggagactgcaaatgctattgtcagtcagcaaactccacaaaggctccttgaagttcgtggaaggctgtatgagcttctaactcattgtattcctcctgagataataatgaaggcatgtaaggaggaatcaagaagctgtgacatattctgaggacctccaaagaacaacttgctactgactggacttctctcatcttttagcatgtgaagttttgcaaatataatccactttgctctgaatgtcctgacacctgcttcagagctcaagattcagactccagcctgaatgttatttcctgagaaaatccctccctgacccactgtgctggttaggtccacctgctaatcacatccacaaaaccctctgcttctccttcaaaacactcatctcctctgtaatgatcagatgaactcatgtctttctcagaggacaataaatttgatgaatggg

SEQ ID NO: 175065 - DNA, 1384 bp, Homo sapiens
  Payload ID: 14376
  Gene Symbol: RFC4
  Gene Name: replication factor C (activator 1) 4, 37kDa
  Uniprot ID: P35249
  ENST ID: ENST00000296273
  CDS Start-End: 224-1315
accggcgtattcccgccctgcttttcgcccgccgttccgtggcgggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgccggggtaataccagctgagaaaattgatggagtatttgctgcctgtcagagtggctcttttgacaaactagaagctgtggtcaaggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagca

SEQ ID NO: 175066 - DNA, 1448 bp, Homo sapiens
  Payload ID: 14376
  Gene Symbol: RFC4
  Gene Name: replication factor C (activator 1) 4, 37kDa
  Uniprot ID: P35249
  ENST ID: ENST00000392481
  CDS Start-End: 283-1374
cgcgctcacgtctgaagtgggagcaatgcaccgggacagggacacctcctaggccatgcctgttccagtccagttctgcctgaaagtccggctggctcatcacctgcctaaataaaaccgtatacgggcaaactccctccgcaagcagcgcgccccagcaccggaagtgacgcgttacgtgcccgcgtattcctaccggcgtattcccgccctgcttttcgcccgccgttccgtggcgggaactgaggcgactgtggggacatcagtgatcggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgccggggtaataccagctgagaaaattgatggagtatttgctgcctgtcagagtggctcttttgacaaactagaagctgtggtcaaggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagcaccttt

SEQ ID NO: 175067 - DNA, 799 bp, Homo sapiens
  Payload ID: 14376
  Gene Symbol: RFC4
  Gene Name: replication factor C (activator 1) 4, 37kDa
  ENST ID: ENST00000449502
  CDS Start-End: 181-474
gggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttggataggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaa

SEQ ID NO: 175068 - DNA, 560 bp, Homo sapiens
  Payload ID: 14376
  Gene Symbol: RFC4
  Gene Name: replication factor C (activator 1) 4, 37kDa
  ENST ID: ENST00000411792
  CDS Start-End: 430-560
agatttctaagtggggctcaggaattataatagatgtccacagctgcatggtcttctctctccacaacacgcagacactattagaagtaaaagccacgtgtcctcaagagggcaaggcaaagcatcttcagatgtctctgcccttaaagcacacgcgttctgctctgcgacgaagcaggacaaggaggacagggacctgcacctccggaggcccgcacctacgaagatagcgggctcgggaccttcggtggaccggcagggttccagaggcccgcgcgccgccgccccgccctcattgctgagcctgccagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaata

SEQ ID NO: 175069 - DNA, 1111 bp, Homo sapiens
  Payload ID: 14376
  Gene Symbol: RFC4
  Gene Name: replication factor C (activator 1) 4, 37kDa
  ENST ID: ENST00000433496
  CDS Start-End: 12-1022
ggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgccggggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagcacctttaaagtgaatatacaa

SEQ ID NO: 175070 - DNA, 479 bp, Homo sapiens
  Payload ID: 14376
  Gene Symbol: RFC4
  Gene Name: replication factor C (activator 1) 4, 37kDa
  ENST ID: ENST00000417876
  CDS Start-End: 1-336
ggaatagcttatcttgttaaagtgtcagaaggagacttaagaaaagccattacatttcttcaaagcgctactcgattaacaggtggaaaggagatcacagagaaagtgattacagacattgccggggtaataccagctgagaaaattgatggagtatttgctgcctgtcagagtggctcttttgacaaactagaagctgtggtcaaggatttaatagatgagggtcatgcagcaactcagctcgtcaatcaactccatgatgtggttgtagaaaataacttatctgataaacagaagtctattatcacagaaaaacttgccttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaa

SEQ ID NO: 175071 - DNA, 485 bp, Homo sapiens
  Payload ID: 14376
  Gene Symbol: RFC4
  Gene Name: replication factor C (activator 1) 4, 37kDa
  ENST ID: ENST00000427785
  CDS Start-End: 117-485
tttgtatcgcggaaacctgaggaacgagccggcggcggtgacctgcacgagaagccaggctaactgagtcccccaccttcccttccccacagaaagtctctgaagggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtg

SEQ ID NO: 175072 - DNA, 701 bp, Homo sapiens
  Payload ID: 14376
  Gene Symbol: RFC4
  Gene Name: replication factor C (activator 1) 4, 37kDa
  ENST ID: ENST00000418288
  CDS Start-End: 59-701
gccgttccgtggcgggaactgaggcgactgtggggacatcagtgatcggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattg

SEQ ID NO: 175073 - DNA, 785 bp, Homo sapiens
  Payload ID: 14376
  Gene Symbol: RFC4
  Gene Name: replication factor C (activator 1) 4, 37kDa
  ENST ID: ENST00000447345
  CDS Start-End: 283-785
cgcgctcacgtctgaagtgggagcaatgcaccgggacagggacacctcctaggccatgcctgttccagtccagttctgcctgaaagtccggctggctcatcacctgcctaaataaaaccgtatacgggcaaactccctccgcaagcagcgcgccccagcaccggaagtgacgcgttacgtgcccgcgtattcctaccggcgtattcccgccctgcttttcgcccgccgttccgtggcgggaactgaggcgactgtggggacatcagtgatcggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatgga

SEQ ID NO: 175074 - DNA, 453 bp, Homo sapiens
  Payload ID: 14376
  Gene Symbol: RFC4
  Gene Name: replication factor C (activator 1) 4, 37kDa
  ENST ID: ENST00000448497
  CDS Start-End: 168-453
tcctttattatgtaacatctttgcacaaggctaagtttattttcgggctgtactttctcataatggttccccaccaccacccccgctttcctatggtgctgattcgcaataaaagtttcaataaaagctttttttttctgtcttgcacctgaccagggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactct

SEQ ID NO: 175075 - DNA, 2449 bp, Homo sapiens
  Payload ID: 14377
  Gene Symbol: RFC5
  Gene Name: replication factor C (activator 1) 5, 36.5kDa
  Uniprot ID: P40937
  ENST ID: ENST00000392542
  CDS Start-End: 534-1493
gaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgagacagggtctcgctctgtcgcccatgctggagcgcagtggtgtgatcacagctcagtgtaacctcaaacattggggttcaagccattctcctgcctcagcctccgaagaactgggacttttagaggcgagctaccaagcccatcctgtaaccattttaaaatgtacaattcagtggcattaagtacattcagaatgcagtgtactgttgtggagtcttcccgctatctagttccaaaatttcatcaccccaaatggaaatcctttacccattgacagttactccccattctccccttcctctagcccctggcaaccactaatctgctttctatctatggatttgcctattctggacatttcatggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcctacagaaatattacagagttgaaaactctgaaggggttggcactgcatgatatcctgacagagatacacttgtttgtgcatagagttgactttccatcttcagttcgaatacatttattgaccaaaatggcagacattgagtacaggctttctgttggcaccaacgagaagatccagctgagctccctcattgctgcatttcaagtcaccagagacctgattgttgcagaggcctagatgctctgagggccattcacaattctcagggctcagcagtgatgggagaacagaggacagttccaggataaactgctgcctggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctaccccattttggtctggaacagaagactttcaaatttaatatggtccaagtgtcttcctactcaaggtaaacattatctccaaaattacatttatgattctaatatttggcattgtgtctgtatctaatttaaacagatgttaatggacgtctggccgaaactattatacttttataagatgagctgaatcctcttactttaaaaactggtctttttatttaccctctgtggtagaagagtcaccagcaggttccaaattgatgtgtatgataggaaaaaaaccttaattttaaatataatatagagccttaaactatgccactgggtggcagaggctgtataaaacgcacttgttttcatgcaggagcggggcaagtaaggttgagcctgactgtaaacctagaactgcggaaggactgggacttttgtacaaatttcacatttattttacagcaatcatgctgcatttgtgttagtgttctttataataaaaaacaaagcagcctcctggctggctgtgttacaagtgactcttccttagacagctagaaagatgctgactttgtcaaacttgcatttatatgaaaaccttctgtctctaatatcacagaataaactttctttagatgctgttcttta

SEQ ID NO: 175076 - DNA, 559 bp, Homo sapiens
  Payload ID: 14377
  Gene Symbol: RFC5
  Gene Name: replication factor C (activator 1) 5, 36.5kDa
  ENST ID: ENST00000420967
  CDS Start-End: 247-559
agagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgcccctggcaaccactaatctgctttctatctatggatttgcctattctggacatttcatggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatg

SEQ ID NO: 175077 - DNA, 572 bp, Homo sapiens
  Payload ID: 14377
  Gene Symbol: RFC5
  Gene Name: replication factor C (activator 1) 5, 36.5kDa
  ENST ID: ENST00000449641
  CDS Start-End: 276-572
agctcaaggaggtggcagcatcatgcttctaatgcaaaggtccttagaaggatggttcttaccatgaatggctcgtaccatgatgggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccc

SEQ ID NO: 175078 - DNA, 1655 bp, Homo sapiens
  Payload ID: 14377
  Gene Symbol: RFC5
  Gene Name: replication factor C (activator 1) 5, 36.5kDa
  Uniprot ID: P40937
  ENST ID: ENST00000454402
  CDS Start-End: 119-1141
gcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcctacagaaatattacagagttgaaaactctgaaggggttggcactgcatgatatcctgacagagatacacttgtttgtgcatagagttgactttccatcttcagttcgaatacatttattgaccaaaatggcagacattgagtacaggctttctgttggcaccaacgagaagatccagctgagctccctcattgctgcatttcaagtcaccagagacctgattgttgcagaggcctagatgctctgagggccattcacaattctcagggctcagcagtgatgggagaacagaggacagttccaggataaactgctgcctggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctaccccattttggtctggaacagaagactttcaaatttaatatggtccaagtgtcttcctactcaaggtaaacattatctccaaaattacatttatgattctaatatttggcattgtgtctgtatctaatttaaacagatgttaatggacgtctggccgaaactattatacttttataagatgagctgaatcctcttac

SEQ ID NO: 175079 - DNA, 574 bp, Homo sapiens
  Payload ID: 14377
  Gene Symbol: RFC5
  Gene Name: replication factor C (activator 1) 5, 36.5kDa
  ENST ID: ENST00000535092
  CDS Start-End: 385-574
aagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgagacagggtctcgctctgtcgcccatgctggagcgcagtggtgtgatcacagctcagtgtaacctcaaacattggggttcaagccattctcctgcctcagcctccgaagaactgggacttttagaggcgagctaccaagcccatcctgtaaccattttaaaatcccctggcaaccactaatctgctttctatctatggatttgcctattctggacatttcatggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggct

SEQ ID NO: 175080 - DNA, 820 bp, Homo sapiens
  Payload ID: 14377
  Gene Symbol: RFC5
  Gene Name: replication factor C (activator 1) 5, 36.5kDa
  ENST ID: ENST00000537315
  CDS Start-End: 509-820
gcgagagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgagacagggtctcgctctgtcgcccatgctggagcgcagtggtgtgatcacagctcagtgtaacctcaaacattggggttcaagccattctcctgcctcagcctccgaagaactgggacttttagagggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtc

SEQ ID NO: 175081 - DNA, 631 bp, Homo sapiens
  Payload ID: 14377
  Gene Symbol: RFC5
  Gene Name: replication factor C (activator 1) 5, 36.5kDa
  ENST ID: ENST00000484086
  CDS Start-End: 214-631
agagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgagacagggtctcgctctgtcgcccatgctggagcgcagtggtgtgatcacagctcagtgtaacctcaaacattggggttcaagccattctcctgcctcagcctccgaagaactgggacttttagagcccctggcaaccactaatctgctttctatctatggatttgcctattctggacatttcatggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagct

SEQ ID NO: 175082 - DNA, 3292 bp, Homo sapiens
  Payload ID: 14378
  Gene Symbol: REPIN1
  Gene Name: replication initiator 1
  Uniprot ID: Q9BWE0
  ENST ID: ENST00000397281
  CDS Start-End: 490-2193
cccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaactggt

SEQ ID NO: 175083 - DNA, 2876 bp, Homo sapiens
  Payload ID: 14378
  Gene Symbol: REPIN1
  Gene Name: replication initiator 1
  Uniprot ID: Q9BWE0
  ENST ID: ENST00000425389
  CDS Start-End: 79-1782
gggaggggagaaacaggggcagagtgagttggtctctggagtgactgtgcttttccaccctcagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 175084 - DNA, 2969 bp, Homo sapiens
  Payload ID: 14378
  Gene Symbol: REPIN1
  Gene Name: replication initiator 1
  Uniprot ID: Q9BWE0
  ENST ID: ENST00000444957
  CDS Start-End: 167-1870
cccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaactggt

SEQ ID NO: 175085 - DNA, 2058 bp, Homo sapiens
  Payload ID: 14378
  Gene Symbol: REPIN1
  Gene Name: replication initiator 1
  Uniprot ID: Q9BWE0
  ENST ID: ENST00000489432
  CDS Start-End: 184-2058
ggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctga

SEQ ID NO: 175086 - DNA, 824 bp, Homo sapiens
  Payload ID: 14378
  Gene Symbol: REPIN1
  Gene Name: replication initiator 1
  ENST ID: ENST00000486714
  CDS Start-End: 69-332
cttctgttttctcttccctccccacaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccat

SEQ ID NO: 175087 - DNA, 1029 bp, Homo sapiens
  Payload ID: 14378
  Gene Symbol: REPIN1
  Gene Name: replication initiator 1
  ENST ID: ENST00000482680
  CDS Start-End: 172-582
cgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgccc

SEQ ID NO: 175088 - DNA, 899 bp, Homo sapiens
  Payload ID: 14378
  Gene Symbol: REPIN1
  Gene Name: replication initiator 1
  ENST ID: ENST00000467980
  CDS Start-End: 64-207
gccgctgtcgccgcggcggggcggggagcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggggagctcagtgtctgtttgtccagcttctcagagttgctgtgcagctcggatgtggcataggaaacagcagacacagggagagggcagcataaggcactgtagggagcagtggccacattttctgaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccc

SEQ ID NO: 175089 - DNA, 1022 bp, Homo sapiens
  Payload ID: 14378
  Gene Symbol: REPIN1
  Gene Name: replication initiator 1
  ENST ID: ENST00000466559
  CDS Start-End: 112-279
cggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccac

SEQ ID NO: 175090 - DNA, 1192 bp, Homo sapiens
  Payload ID: 14378
  Gene Symbol: REPIN1
  Gene Name: replication initiator 1
  ENST ID: ENST00000475514
  CDS Start-End: 95-1192
ggacgggcctggcagttgtgaactcgaacctgccgctgtcgccgcggcggggcggggagcgagagtgggccgcggaggccggccttcgggctccatggacgggcgccgcgtccctgcacagcccgccgcagagttttctctaacacctgggggctaccggagtgtgggccgaagcaggcgctgcagccgcggaagtatccccaggaacatccccaagaggagctggaaaaagcctcatccccagctctgcagtctccaggaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctg

SEQ ID NO: 175091 - DNA, 1262 bp, Homo sapiens
  Payload ID: 14378
  Gene Symbol: REPIN1
  Gene Name: replication initiator 1
  ENST ID: ENST00000488943
  CDS Start-End: 82-1262
agttgtgaactcgaacctgccgctgtcgccgcggcggggcggggagcgagagtgggccgcggaggccggccttcgggctccatggacgggcgccgcgtccctgcacagcccgccgcagagttttctctaacacctgggggctaccggagtgtgggccgaagcaggcgctgcagccgcggaagtatccccaggaacatccccaagaggagctggaaaaagcctcatccccagctctgcagtctccaggcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagc

SEQ ID NO: 175092 - DNA, 3182 bp, Homo sapiens
  Payload ID: 14378
  Gene Symbol: REPIN1
  Gene Name: replication initiator 1
  ENST ID: ENST00000479668
  CDS Start-End: 89-499
ctttttgtgctccactttggaacaaatcggaagctagggccttccaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 175093 - DNA, 480 bp, Homo sapiens
  Payload ID: 14378
  Gene Symbol: REPIN1
  Gene Name: replication initiator 1
  ENST ID: ENST00000522266
  CDS Start-End: 7-150
ggctccatggacgggcgccgcgtccctgcacagcccgccgcagaggtacggccggggcaggggcgcggggccaccgcgggcccgcggggggccgctccacctgcggggcgcgtgaccgtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgccc

SEQ ID NO: 175094 - DNA, 478 bp, Homo sapiens
  Payload ID: 14378
  Gene Symbol: REPIN1
  Gene Name: replication initiator 1
  ENST ID: ENST00000518514
  CDS Start-End: 33-443
gagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtgagtgtgcgcgaccgtgtcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttag

SEQ ID NO: 175095 - DNA, 583 bp, Homo sapiens
  Payload ID: 14378
  Gene Symbol: REPIN1
  Gene Name: replication initiator 1
  ENST ID: ENST00000519397
  CDS Start-End: 145-583
agaggaagcccagcaacttctgctctttcttaatttctagaaaagagtgaagagaggccttttcaaagttcgcaggatcgggcctttttgtgctccactttggaacaaatcggaagctagggccttccagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgctt

SEQ ID NO: 175096 - DNA, 4340 bp, Homo sapiens
  Payload ID: 14379
  Gene Symbol: RPA1
  Gene Name: replication protein A1, 70kDa
  Uniprot ID: P27694
  ENST ID: ENST00000254719
  CDS Start-End: 111-1961
cgggagcggtgcgcgcaacttctcgggccaataactgcgcagcgcgcgggacccgggtggggaagctggagctgttgcggggtccgcggggaagtcttggcggtggagccatggtcggccaactgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcccccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgccgtcccctaaggaaatccgagcggctacaaagcgtttctttacttctcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatcctactttctttgaatgcaaagagttcctataactggaaagcaattaattagccttcataataaatgttcacttgggggggatgttaactcattataaacccgaagattagtccaaggcatggagatccttcttcctagtgtttgcagccctgaaatgcatctttcaaagcatgaaaacactaaaaacaaaaagccattttgcctgaggatgctgatgatctggcacttgggattttattgatgtttacgcagcagtctaacaccaaccacgctttgaaatgtgtacagacagtgagctggtaagaaaacagtaattatgctagtgggcctttcagtcagcaaaagcatgctcgctctgtgtgttcctaatcatattaattatctatccggtggctgcaacacaccgcctgccattggccgcacatctcgccgtcgtaccccggcagtgcggcggtcactctgcagccagaggacctgctgttcatcactgcacatgccgcctgcggaggcttttggatatggggagtgatggtgtcctgtctgtctcccccctcggtgtctgccgttgacataggggccagccagccctagacgggatgacttccgttcctgaggacagacacagagggactcctgctcagcctcactaattgtttagacacattccttcctacccttctctagtctcaggagatggtaactgggtcgcatttcagtctctgactgaggcctcagccatttttacggaagttcttttctgtctgaccttgcttataaagcatcgacgagaaaattacagtcttcaaccctcttctggattgacaaattgtggctgggaagtggcgatctagctttcagcccagtaaccagtctttcatgcctactactcccagcattccctcctctccccacgtgtctgtccacacagtgaagaggcctgaccagccgtggtaccaggacaggacgtgtccagggaacgctgacacctgtcctcgcgccttctcagtggccagcgtgatgaaaccagcacgtctccgtggatgtgattgggaacccaggggcagtgccagggggagggctccctcgaggaggctgtttctaacagatttccccactcaaagatcagatcaccagcagaggagcatcagaaactggctccactgttgggcttttcagagattttggtccctgcgggttgcctaaatagattctggcccacagtttacctcgaaaggctgttgatgttgttctgtttctcctctttcacttagagatcaatgttgattttgcgtacaccatgacatcagcgttaggcaattaggagaaaaaaatctaatcatttcgcctttatttcaagtggttcttgaattccctccagtctcattgtgaaaggggcagggaaaaaaataaaagggtaataatctgatttctgtccatatttccagtgttttatgctttccattaaaaccttgctaatctct

SEQ ID NO: 175097 - DNA, 630 bp, Homo sapiens
  Payload ID: 14379
  Gene Symbol: RPA1
  Gene Name: replication protein A1, 70kDa
  ENST ID: ENST00000570451
  CDS Start-End: 171-630
cgcacgtcgggggcgggagcggtgcgcgcaacttctcgggccaataactgcgcagcgcgcgggacccgggtggggaagctggagctgttgcggggtccgcggggaagtcttggcggtggagccatggtcggccaactgagcgagggggccattgcggtgaggaggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaa

SEQ ID NO: 175098 - DNA, 3849 bp, Homo sapiens
  Payload ID: 14379
  Gene Symbol: RPA1
  Gene Name: replication protein A1, 70kDa
  ENST ID: ENST00000574049
  CDS Start-End: 1-942
ttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaaggtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcccccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgccgtcccctaaggaaatccgagcggctacaaagcgtttctttacttctcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatcctactttctttgaatgcaaagagttcctataactggaaagcaattaattagccttcataataaatgttcacttgggggggatgttaactcattataaacccgaagattagtccaaggcatggagatccttcttcctagtgtttgcagccctgaaatgcatctttcaaagcatgaaaacactaaaaacaaaaagccattttgcctgaggatgctgatgatctggcacttgggattttattgatgtttacgcagcagtctaacaccaaccacgctttgaaatgtgtacagacagtgagctggtaagaaaacagtaattatgctagtgggcctttcagtcagcaaaagcatgctcgctctgtgtgttcctaatcatattaattatctatccggtggctgcaacacaccgcctgccattggccgcacatctcgccgtcgtaccccggcagtgcggcggtcactctgcagccagaggacctgctgttcatcactgcacatgccgcctgcggaggcttttggatatggggagtgatggtgtcctgtctgtctcccccctcggtgtctgccgttgacataggggccagccagccctagacgggatgacttccgttcctgaggacagacacagagggactcctgctcagcctcactaattgtttagacacattccttcctacccttctctagtctcaggagatggtaactgggtcgcatttcagtctctgactgaggcctcagccatttttacggaagttcttttctgtctgaccttgcttataaagcatcgacgagaaaattacagtcttcaaccctcttctggattgacaaattgtggctgggaagtggcgatctagctttcagcccagtaaccagtctttcatgcctactactcccagcattccctcctctccccacgtgtctgtccacacagtgaagaggcctgaccagccgtggtaccaggacaggacgtgtccagggaacgctgacacctgtcctcgcgccttctcagtggccagcgtgatgaaaccagcacgtctccgtggatgtgattgggaacccaggggcagtgccagggggagggctccctcgaggaggctgtttctaacagatttccccactcaaagatcagatcaccagcagaggagcatcagaaactggctccactgttgggcttttcagagattttggtccctgcgggttgcctaaatagattctggcccacagtttacctcgaaaggctgttgatgttgttctgtttctcctctttcacttagagatcaatgttgattttgcgtacaccatgacatcagcgttaggcaattaggagaaaaaaatctaatcatttcgcctttatttcaagtggttcttgaattccctccagtctcattgtgaaaggggcagggaaaaaaataaaagggtaataatctgatttctgtccatatttccagtgttttatgctttccattaaaaccttgctaatctctcgcgtgctgttccttttttgaactgcagggtcaaaaatgttcccctcccccacttctgtttcctgagtgggctgtcttcaaaaagtataaatactattgatcgtggtatttaatacactaatgaaacccatggttattgactacataattaatatactgtccaaaagtgaagtttggccgcccagtatgtaaaggtttatattgactcatgtttctttggcaatatgccgcccaaggttttatttatagaggatgaaacaggttgtttggtctccttttcttcttttcacctgttagaaggccactattcccctagtaaactgattgtttccttgtctcaaagggaagattccccccactccccggccaccttttatgtggtttgttaactcttagtcttatatccactccgctggtagagttctggcttttataaacacctttggaagtcatcggttcctcaaaaagagagcatagatgtttaattttcacttattcaaaaaaactggtatttttgttattaagaca

SEQ ID NO: 175099 - DNA, 577 bp, Homo sapiens
  Payload ID: 14379
  Gene Symbol: RPA1
  Gene Name: replication protein A1, 70kDa
  ENST ID: ENST00000571058
  CDS Start-End: 206-577
tttaacctcctctgggataccaacccgtgcactcgccagagaccgaggcgagaacgcctcgagaaccgctcagacgcgcccggaactgcgccctggtctccctcccagcgcccgcgcagctcctggcgcgccccttggcgccccgctccgccccgcaccgcgtccggcgtcccgcgccaggcctcgcttgggaccatgggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagca

SEQ ID NO: 175100 - DNA, 1237 bp, Homo sapiens
  Payload ID: 14380
  Gene Symbol: RPA2
  Gene Name: replication protein A2, 32kDa
  Uniprot ID: P15927
  ENST ID: ENST00000313433
  CDS Start-End: 71-1147
gttctgtggttttccgctattcccccagacccgcaccttctcggcctctttgcggagaatcgtgaccaagatgtggaacagtaatgatgggggtgcggggtggaggaggaagagaatcgcaggaggttttagcaagagggcgagcctagggtccgagaggcgtgtggtagcgggagaggaagggcgggagcggagctggggcgtttgggggtcacccgcaggaaggcggcgaggaaggttagggagactcgggcagtgtttgaaggggcgaagcctccgggagcctgcgggtttctcggaggcgtgggacgtggcacaggcactaatcctgttgttcaaaacaggtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccaggggg

SEQ ID NO: 175101 - DNA, 1162 bp, Homo sapiens
  Payload ID: 14380
  Gene Symbol: RPA2
  Gene Name: replication protein A2, 32kDa
  Uniprot ID: P15927
  ENST ID: ENST00000373909
  CDS Start-End: 87-923
gctagtgcggagggttttgcccttcgtaaagatggccgcggaggcttttggagccaactgggagcgcagtacgcgttttctggagcatgggcagaggagacaggaacaagcgtagcatccgtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaa

SEQ ID NO: 175102 - DNA, 1752 bp, Homo sapiens
  Payload ID: 14380
  Gene Symbol: RPA2
  Gene Name: replication protein A2, 32kDa
  Uniprot ID: P15927
  ENST ID: ENST00000373912
  CDS Start-End: 301-1113
agtgcggagggttttgcccttcgtaaagatggccgcggaggcttttggagccaactgggagcgcagtacgcgttttctggagcatgggcagaggagacaggaacaagcgtagcatccgtgagcaccgattggctgaagcgagcaccccgggagctgactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgtagtaacttgtaaaaa

SEQ ID NO: 175103 - DNA, 682 bp, Homo sapiens
  Payload ID: 14380
  Gene Symbol: RPA2
  Gene Name: replication protein A2, 32kDa
  ENST ID: ENST00000444045
  CDS Start-End: 146-682
gactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtaatgatgggggtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccag

SEQ ID NO: 175104 - DNA, 554 bp, Homo sapiens
  Payload ID: 14380
  Gene Symbol: RPA2
  Gene Name: replication protein A2, 32kDa
  ENST ID: ENST00000419958
  CDS Start-End: 1-369
ctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactggaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgta

SEQ ID NO: 175105 - DNA, 2020 bp, Homo sapiens
  Payload ID: 14381
  Gene Symbol: RPA3
  Gene Name: replication protein A3, 14kDa
  Uniprot ID: P35244
  ENST ID: ENST00000223129
  CDS Start-End: 1173-1538
aagctactcagataagaggctccaagaggacatttttggatgtgaaaaacaatgagaaggaggacaacacacatttacaatcgtcttaattttgtactcagaaaaaggatgtgaagacaatgcacagggaatacaatagtttcagatctgtgtacagtttccttttgcttcatctcctgcaacaatgtaatgaagacaccatgatatcattaacatttcacacaaaaggaaaatgaggctgaaatggtgtgggcaaggcccaggaatctggagcatccctaaccaagcaggagagcacctgggatagagaaagtgctcaagaatgttcacttactgattactacaatcaaaaaaagatacgacactaatttaccacattcttcttacttattttatgagatactattcttccaaggtggagaaagtggagaaagtagagtgacgcagctaagggagtaaatcgaccctcagccaacaagtggcaaaagcctgaagaaagtgatcaagatcactgatgaccccgctgcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaaggtagtctcaggttccgcccctatccaagtcccgcctccactgcctctcgccctgtatctgtcaacttccgggacgccgcgcgtcactaagcagccaatctccacttccggactcatccagccccttctccacccctttcagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagagatttctgtgctttctcatatttaatttgctgtttttaagatattccaacctagagtttttgatggaactgatatattgacagttctcaccgaagtccttttataaagaattgctactccaatatatggtcagattagatgcaagaataaagcagttgtccgagtctaagtttctattttattaataaaaactaaaatggtacgtactatcggtcatttcattttcattcttttaatcatgtattcaagcacaaacttgaaatttcatagccataaggtcaagatttagacctaccaaataaaaccttgggccagctgtgttaaggatttgctcaccttttcccaaactataccttgataattatttccttgataccctacttacaaaatgaagtagatgacatt

SEQ ID NO: 175106 - DNA, 847 bp, Homo sapiens
  Payload ID: 14381
  Gene Symbol: RPA3
  Gene Name: replication protein A3, 14kDa
  Uniprot ID: P35244
  ENST ID: ENST00000396682
  CDS Start-End: 414-779
gggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtt

SEQ ID NO: 175107 - DNA, 434 bp, Homo sapiens
  Payload ID: 14381
  Gene Symbol: RPA3
  Gene Name: replication protein A3, 14kDa
  ENST ID: ENST00000406109
  CDS Start-End: 113-361
gctggccccgcagtcccccgccgcaccagcaccggagcttcacaccccacttccggggtcaagtcaccgccgggaatcctgtgatcgcagaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagg

SEQ ID NO: 175108 - DNA, 414 bp, Homo sapiens
  Payload ID: 14381
  Gene Symbol: RPA3
  Gene Name: replication protein A3, 14kDa
  ENST ID: ENST00000401447
  CDS Start-End: 141-389
ccttcagatttcttagtttactcagacgtgacggacgcagacaaaactaatctgctggtttccttctcttctgaaattacttatttttgcaaacctcgtttcctcgttgtgatcgcttctctattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgt

SEQ ID NO: 175109 - DNA, 1560 bp, Homo sapiens
  Payload ID: 14382
  Gene Symbol: RPA4
  Gene Name: replication protein A4, 30kDa
  Uniprot ID: Q13156
  ENST ID: ENST00000373040
  CDS Start-End: 404-1189
ctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaa

SEQ ID NO: 175110 - DNA, 1745 bp, Homo sapiens
  Payload ID: 14383
  Gene Symbol: RTFDC1
  Gene Name: replication termination factor 2 domain containing 1
  ENST ID: ENST00000023939
  CDS Start-End: 114-1124
acgaccagcgtgctgcgtcacggcggtgcgccggaagtggctgcggatttcgccggaaatcccggaagtgacagctttgggggtttgctgctggctctgactcccgtcctgcgatgggttgcgacgggggaacaatccccaagaggcatgaactggtgaaggggccgaagaaggttgagaagatttggcatttgaagaatgggaaagagtggtgcagtctacacagtgaaggaaaaaacaagaacgggaaggagtgggacatggaatatgatgtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcatgctcaatggcaccaaggaggatgtggacgtgctgaagacaaggatggaggagagaaggctgagagcgaagctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttctctc

SEQ ID NO: 175111 - DNA, 2212 bp, Homo sapiens
  Payload ID: 14383
  Gene Symbol: RTFDC1
  Gene Name: replication termination factor 2 domain containing 1
  Uniprot ID: Q9BY42
  ENST ID: ENST00000357348
  CDS Start-End: 108-1028
agcgtgctgcgtcacggcggtgcgccggaagtggctgcggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcatgctcaatggcaccaaggaggatgtggacgtgctgaagacaaggatggaggagagaaggctgagagcgaagctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttctctcctctgtgtttttatcttttctaccttctgctcatgcttgggtaagaacattgcagccgttgcattggtgattacaggagtcattccatgaagtcagaagaacccacccttctctcctccagcagatggtaaagggagaatcgtacccaaaaagaggtgcattttatctgcctataagttgtgttgacgtcaatagctagtgaaacttctcatgagactcctaatgaagaaccaagagccacaggcctctgcgtggctttctgcacacggtggtatgactgagatagtgactggttctctatacagaccccggggccctgggtttccttcagaagcagaaggagctgtgggaggtgaatggtgggaggtgaacaggcaggttctgtgggagacacagacacgtgggcagaactccagggagaggccagcaagggagaaccatgtgtggccctgctttttctcaaaccctgtgtggttcccggcttcacagttgatgggaaggtttggccccaaggatattttgacattgtgagtatagagcattttaataaaaattaagtgatg

SEQ ID NO: 175112 - DNA, 1572 bp, Homo sapiens
  Payload ID: 14383
  Gene Symbol: RTFDC1
  Gene Name: replication termination factor 2 domain containing 1
  ENST ID: ENST00000395881
  CDS Start-End: 85-777
gccggaagtggctgcggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcatgctcaatggcaccaaggaggatgtggacgtgctgaagacaaggatggaggagagaaggctgagagcgaagctggaaaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttctctcc

SEQ ID NO: 175113 - DNA, 852 bp, Homo sapiens
  Payload ID: 14383
  Gene Symbol: RTFDC1
  Gene Name: replication termination factor 2 domain containing 1
  ENST ID: ENST00000449062
  CDS Start-End: 21-852
gctctgactcccgtcctgcgatgggttgcgacgggggaacaatccccaagaggcatgaactggtgaaggggccgaagaaggttgagaagatttggcatttgaagaatgggaaagagtggtgcagtctacacagtgaaggaaaaaacaagaacgggaaggagtgggacatggaatatgatgtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcatgctcaatggcaccaaggaggatgtggacgtgctgaagacaaggatggaggagagaaggctgagagcgaagctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacag

SEQ ID NO: 175114 - DNA, 15003 bp, Homo sapiens
  Payload ID: 14384
  Gene Symbol: RIF1
  Gene Name: replication timing regulatory factor 1
  Uniprot ID: Q5UIP0
  ENST ID: ENST00000243326
  CDS Start-End: 484-7902
tgagtaaacagccggagctgggaaagtcgagctctggcagcgtctgggtgctgaggggcagaggcggagagaaccctgtcctgatcttcctaggtgggataaatatcggggtgacagtggtaggccgcggggaaccctcagtctgcccaccctccgccccctcgcggcgagatgcctcgttccccgggcttctcccgccctccgccgatctcctccctctgttgaaagctgcccgggaaagtggtggcgggagcgggcccaggcccgaatgtggcgtgggctcaggtgtctggtgtcgggcgccggaggaggttcgcgctggggtttggtgattcggaggcctggggtgcagacgcggcgtggctgtgaggcccgggcgggcgtgcgggtgtgagggccggactcacactgggccgccgcggggctgtttccatcggtcactggattttctcctcttccggttcgggcctcagggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgttggtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaagtttcaacttctggcggttaaaatattaatgcagaatttactaagattttattcatttgcattagcaaatattcatgcagcagcagttgactgaaaatttattcttatgagacgtatagtattcatttttaaatgcatgattgtacattatgtatagacgacaatgtttttaatttataaatttcattctttgttaattgcatgggtttttctgcagcttattgtgaataccttggttctgttcaatagaaacattttgtatatattaaatactgaaatatcagtatcgacggtggaagtgcttcatgggcttgctgcacatatttgtaggatactgtatctgcaaatgcaacaacaaatagttttgtacttggttaacagtcttagttaaaacatgagtttattttctaaaagtatccagaataagtaaaattatagaaataagaaaatgttacacaactttgctgttcatacccttaccttcttactacttttggtttggaggagggtatcaccactagaaagtgtgcctccttaagatttcttaaaggaaagttagtttcagtatttcacagcaagttggactacaaaatctagagttgatctgctttttaaaccttcatttaaaagcaaacttggaagaaatttgaaactgatgtttttaatatatgtctgtgttgcctaggttttctttttttaaagaggtatgtaattaaaacctttgtaaaatttgccaactaatattagtgcctgacttcccatatttgtttcatctttttaactgacagtatatctcacttcttctttgaatagaatgagtgagtgatctcagttttcacattttattcagaagctaatccctacttagcaaggcacacattctacagcaagtcatagaaagtttaatccttgtgcctccttagctctcgtatattcagggatctctataaaagttggtgtcttttttcatcatcataaattcatcataatcacagatatttttgggtctaagatattcatataccaaggatggttttgtaaagaattctgggatcattgaattaaggattgtggcttgaagtaactaaagaaaaatactaatttccttaaaaggaattataattatgatttacattttacatcattaatttcccaaattatatttaaccgtaaggaggtgcacatgagtttttagcaaacaggtatgaataagcagctatgtatatgtgtttggggcagaggggagcagattactttaacacacttcagaattaaaatcagttcgtttcatgactctgtgccttaacgtttgtgtgaactaaacttgctgattgaatgaaattcttgggaagccgaacagtaatagcagaaaatgtgaccaaatgagtatcatgtacttaaatcactgaattttatataagcacaagtattaattttaaaaacattatagtttaataaagctgcatttaaaaatatttgggagcaaagacaagcatgctaaatcttcattttgctatggctataagcatatatttttggcaacttatttgcaatattcttgccttaaagtttcctgcaaatttcccccttagtaattcccgaatagcaaaacattaatattccatgattagctctactgtgttgtctcactattaaaatggaattcgttttttcagatcttttctaatggttaataaaacaaatgtcagatcataataacactcaaatgtgtcttaattgtcttatgcatatttaagaagaaaaaactagtggcatacaggattgtcatgtagtatctttttttttttttgagacacagtcttgctctgttgcctatgctggagtgcaatggtgcgatctcggttcactgcaagctctgcctcccaggtttacaccattctcctgcctcagcctcccaagtagctgggactacaggtgcccgccaccatgcccggctaattttttatatttttagtagagaaggggttcactgtgttagccaggatggtcttgatctgacctcgtgatccgcctgcctcggcctcccaaagtgctgggattacaggcgtgagccaccccacctggccattttcttttttttttgaggtggagttttcgcccttgctgcccaggctggagtgcagtggtacgatctcagctcactgcaacctccacctcctgggttcaagcgattctcctgcctcagcctcccaaatagctgggattacaggtgcctgccaccaccactggttaatttttgtatttttagtagatacggggtttcaccatgtcagccaggctggtctcaaacttctgacctcagatatccacctgcctcagcctcctaaaatggtggcattacaggcgtgagccaccgctcctggcccatcatttccatatctatgaaatctattttggattttagagtggatttaaattttcaatatttcagtgacctcattgttaaagctgctttgccacttgtacaagtttgaaaaccattgttgaatcatatggagctttactctaattccaaatagttaaaggatgaatcaggttaaataatgctgttggataatacaggcaaaaacaggatttaaacccgcacattaaaagcatgactgaaggcccggcaggtggatcactttggcccaggagttcaaaactgacctgaacaatgtggcgaaatcctgtctctactaaaaatacaaaaaccagccaggcatgttggcgcatacttgtaatctcagctactcaggaggctgagacatgagaattgcttgaaccttttaggcggaggttgcagtgagccgagatcatgccattgcgcgacagagcaagtctctgtctcgcaaaaaaaaaaaaaaagtttaattctaacattgcccatggatttttttttttctgtacagcttgaagataagatagttaaagactctgttacaatttaaacatcataaaaatgtgaagagtaagtggtgaggcaagaaacaaaattgggggaaatggtggggatcgtgaatatataagtgaagttttatttttttaaggtgtaaaggagtgagaatagagtaattgctttttaaaaagaaagtataaatgggttaatttttttcttccaactttgactttaattcagtaagaaaggcctaggtttcatctcatattcttcataattgattttcaagaagttaatttgtcattcagcctaggaggctataaaacagcagttagttggcattattagactaaaacttgggtggggggaggagactgtttcctcattgctgcaacccatggtctatcctattcctaagccattagaaagaccttgtactttgtatagaaacattagagtgaggttttgatttttaacatagtactctcaaactttgatgtgcatatgaacaagtggattctgattcagtagatctgcattgggccccgtgagtctttttaaacacagtcccaggtgattcatgcagatgcctgtgaactgcgctggtagatgggcctaagaggcttcaggctgtgttttaggttttggtaagccaggcagattcaagtccttttataactgtcaattttgtgaattggggatgcagactggttttgaaggcttaaagttcaaaaattataagaaagttaagaattttgcttaagagccttttaaaaatatggacgatttattttttaagtaggcagactaagaatttcaagttataaagaatcttattgataaggcaaagtagacaaagtattttctcatgagtatttgtgggttatgtttttgttaatataaaagttgatttctaagtattagaatatatttagtctctaaataaatcttgccttctattatggatcatcgttattaataaacatggaaaatcaacactacccctaatattaatctggcagttaaatttagtagtgctataatgaataagtcagtctagcagatatgccctgtcattatactgcggacctctggtcacttaattttctgttatattatgtggttgaaaattcctgtttcatcgtaaagtgaaatttgaaagatggagttgaataatatgattctcgaaaagtgagtttttcttggaattctgttaaggtgttagattttcctcacatatttaaataatctgtaagaactaccctgaaagcactaaggaaaatgtagccgaaagttaagtaataggttttaaaaatttatcaaaatttattgatagtttgatctgtaaaacaaattgggtttcgtgctttctgatgtccagttaataagtatattatgtgccaggctttacatattgctctttgcaagtagccgttaaagtgtaagtcattgaagtttgaagatctataaatatttaatatagtagtctaaacagttgtgagaatttactcagttctgaaatagaatgttaaattttccgatgtggtcctaatcatttttttctttacatactaagccttcctttctccaaagaacagttaaaaccaaatgtgttatggtaagctgtaaataccgttggaataaaagataaccgttcatcttacctaaaaaattgaagacaatattttccattgttgatgtcacaagtaagaaaaaaactctaacttttgtactctacttgtagcagagggaatatttttggccacagtgtgccaatttataattgtagataaagctgaatttactgggcagcaagcttatatgctgatagaagttgatgcactgagaagtgatgagttgaagagaatggaaaaggcagattgagctggaattttaatgcatagtacatttagtagagagacaagctgtcctatatactcctgtatacttcagaaatagctgatagcctatagtctctgagagctattctgtacatagcacagtattataattgatgttcataaataccctgagagattatgttaaaatacattattaatactcccacaaaagcagtaagttaataagtatttccaacaaaaggcagctttgtttcttaaacggataaacaacatataactaggaagatcatcttcaaaataaagtgtcatggaactgaaaatagagtatagtctaacaattattttgatacactattgaatagctaacaagtgtctaaagaattttttatttttatagaataggaagtttctaaaagaaaacaattaagagcaaaattggttttgagtatagaaactgaaggatggcagtcttaactcctaagttttttacagagcacagattggtaaactagcatgccacctgttttttgtactatctgtgagctgagactggtttttacattttttaatggtgaaaaaagtcaaaagaaggacattttgtgacacatgaaaacatattaaattaaaatttcagtatccagaaataaagttttattggaacagctgtgcttattgtctttagctgctttcctggtacagtggctgagtttagtagtatagcagagtctgtatggcttccaacagtcaaaatactgcctggccttttaaagagtttgtcaatcccttttatggaggaaggttttgctcatgcatggcatgttagtcaatttagttatttgcttctagctggcagaatgtggtcttgattacttaatttctgttacccctgtgttttccagaatggcttctcctgattttacttacgtgttttactattgctcaaattacagatactaggaaacactactactttataagtacacttctttttcctacttaaactctcaaactacagttacgtatttgccatgatgttaagggaccttgatggtctgtgaattatcagttgctttctgcactacctcctgtagatagacctgactgatagcacttacaaaaagactgatagatgccaaatcagtcatttattaaccctctaatattgttgtcccgatcatttggtaaacgctaagagagcttagttttacattcacaaagtatttgtatttgataagtcttaaaaatgatttaagttgaagcctaacagaagtacttgttcattcctcagttacctgcaaataatggaaataatggtgcagtcagttttatttgattgtgtaatgctttatactaggggtctcaaacccctgggtggcattagattcttacaggagcgtgaaccctattgtgaactgcacatgcaagagatctaggttgtgcgctcattatgagaatctaatacccgatgatctgaggtggaacagtctcatcctgaaaccatctaccccaacacctgtgtctgtggaaattgtctccacgaaaccggtccctgttgaaaaaaggttaggggaccactgctttatacagtgtttgaagtaggcacacttacagttactatttctggttctttatgactgttgagggggggcagaattctatgtttgattcacagtaaaacttttcatgaatcattgagggttaactgttatcacttgccaatggaaactggatattgaaacatttttttaagaaatgcacttttacctgaaataaaactataaaaactaaa

SEQ ID NO: 175115 - DNA, 7897 bp, Homo sapiens
  Payload ID: 14384
  Gene Symbol: RIF1
  Gene Name: replication timing regulatory factor 1
  Uniprot ID: Q5UIP0
  ENST ID: ENST00000444746
  CDS Start-End: 162-7580
cgcactcctgggcccgcccagccgccatcttggtctaggagggagcgcgccgcacgcgtgagtaaacagccggagctgggaaagtcgagctctggcagcgtctgggtgctgaggggcagaggcggagagaaccctgtcctgatcttcctagggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgca

SEQ ID NO: 175116 - DNA, 2534 bp, Homo sapiens
  Payload ID: 14384
  Gene Symbol: RIF1
  Gene Name: replication timing regulatory factor 1
  ENST ID: ENST00000414861
  CDS Start-End: 1-2534
agctgggaaagtcgagctctggcagcgtctgggtgctgaggggcagaggcggagagaaccctgtcctgatcttcctagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaa

SEQ ID NO: 175117 - DNA, 3552 bp, Homo sapiens
  Payload ID: 14384
  Gene Symbol: RIF1
  Gene Name: replication timing regulatory factor 1
  ENST ID: ENST00000454583
  CDS Start-End: 1-2240
ggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatccttcctttctccaaagaacagttaaaaccaaatgtgttatggtaagctgtaaataccgttggaataaaagataaccgttcatcttacctaaaaaattgaagacaatattttccattgttgatgtcacaatttcttgaagatggctctttgcagcctacgtggtagtggagatatatacaaaggacttccctagtatcgttggaccaacaagcacaagcagatggcaggaagattagaacattggatattgattgccagtttttaagtgtcattcttggaaacgtgggagatttaggaaatgacattgaagaggaagaattctgttgaaatagtgattctcaacgtggggtccttggacagcaagtgatggggattggaatcccttttccaacgttttctttatacaacacctgtatgacacaagaaagcatccagaaaaaacaagagcagtcaaaacagccctttcatctaccttgtggggaacctggtataaaactacagacgtcagacagaaaagacagattcaacaagtcaacctctctgttcaggcacagatctggttttaatgatgaactctacaatgctaattctggaaatgaaaaagtacaatggaaagcattaagttatataacgctgaggaatcttgttaattctacttatagtatttcaaatctagtcaagtcactgaaaatgttcaagtataatcggaaatgtgtctttccgatagccgttcctggtgagacatcctctttatataaaacctgggcattcagaatcaggacagtgttaacacagaagaaaagaaaacccagcagttcctggagaaagactaggacacatggcttttgtgaaaacaagacactagacgatgttcccaggggttttcgccatgaaccttgccatgggtgaggaaaagatactatattttctccccaataccaccaacgaagtaacagatgagtctttcatgctgtgatttgggattaagatacaaggtgagcccagagatgaattgggcacacatttcctggggcaggatgggagttgtggagggctgcacaacagccccactgcaagcctgggatatccagaggcatcttcctcagcacccctaggtgcctgtgggctgtgccttacatttaataaaaacttacaaggctgaa

SEQ ID NO: 175118 - DNA, 8053 bp, Homo sapiens
  Payload ID: 14384
  Gene Symbol: RIF1
  Gene Name: replication timing regulatory factor 1
  Uniprot ID: Q5UIP0
  ENST ID: ENST00000453091
  CDS Start-End: 162-7502
cgcactcctgggcccgcccagccgccatcttggtctaggagggagcgcgccgcacgcgtgagtaaacagccggagctgggaaagtcgagctctggcagcgtctgggtgctgaggggcagaggcggagagaaccctgtcctgatcttcctagggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgttggtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaa

SEQ ID NO: 175119 - DNA, 7722 bp, Homo sapiens
  Payload ID: 14384
  Gene Symbol: RIF1
  Gene Name: replication timing regulatory factor 1
  Uniprot ID: Q5UIP0
  ENST ID: ENST00000428287
  CDS Start-End: 65-7405
actcctgggcccgcccagccgccatcttggtctaggagggagcgcgccgcacgcggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgca

SEQ ID NO: 175120 - DNA, 7992 bp, Homo sapiens
  Payload ID: 14384
  Gene Symbol: RIF1
  Gene Name: replication timing regulatory factor 1
  Uniprot ID: Q5UIP0
  ENST ID: ENST00000430328
  CDS Start-End: 335-7675
ccctccgccccctcgcggcgagatgcctcgttccccgggcttctcccgccctccgccgatctcctccctctgttgaaagctgcccgggaaagtggtggcgggagcgggcccaggcccgaatgtggcgtgggctcaggtgtctggtgtcgggcgccggaggaggttcgcgctggggtttggtgattcggaggcctggggtgcagacgcggcgtggctgtgaggcccgggcgggcgtgcgggtgtgagggccggactcacactgggccgccgcggggctgtttccatcggtcactggattttctcctcttccggttcgggcctcagggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgca

SEQ ID NO: 175121 - DNA, 1471 bp, Homo sapiens
  Payload ID: 14385
  Gene Symbol: RPRM
  Gene Name: reprimo, TP53 dependent G2 arrest mediator candidate
  Uniprot ID: Q9NS64
  ENST ID: ENST00000325926
  CDS Start-End: 244-573
gcgagcgccgggaacgagcaccaccagggctggagcggacggctttagaagagcctagctgctgcgcgcgtcggagaggctcctgggaaactcccacggcccagggactttcgaaagcagagcgaggagccctcgcacgcgctagtctgcgagtgagcgctcagcccggcacctgttcctccagcgccgccgccttcccacccctcggacccgcgccgctcgcggcgcccgcccgttcctgcgatgaatccggccctaggcaaccagacggacgtggcgggcctgttcctggccaacagcagcgaggcgctggagcgagccgtgcgctgctgcacccaggcgtccgtggtgaccgacgacggcttcgcggagggaggcccggacgagcgtagcctgtacataatgcgcgtggtgcagatcgcggtcatgtgcgtgctctcactcaccgtggtcttcggcatcttcttcctcggctgcaatctgctcatcaagtccgagggcatgatcaacttcctcgtgaaggaccggaggccgtctaaggaggtggaggcggtggtcgtggggccctactgacccgccctctgcccccgcggcaaccgctcccacgcctgcccactttgctagcccggctgtgcccctcactatcagagactgggcgaagcaaacctgtcggagtcaattatttctctcgacttcggcctttcggaaagaagcgaccggtttctccctcgccctctgaaagtcctcatgcctggcagtcggaggagagcgcccagactctgaactcagcagaaagtggcaagaagagggcgattagggcgcagaactttggaagctgctacttacttggaatgcggggagaccgacggtgcgaaggcccttctccacccgcaggtgggccaagctctgggggcaggtggagagggcgggcaggggagagacccagcggcactgatcgccttgtgaccggaagagtgacctgttaaaagccacgcagcagactcatggggtctcacaaatccgtgtccgggtgcgctcccactcttctcctgctccccccctgccctggaggggaggggcgataaatacctttgattgtaacgtgccgttttaagaggttttgtgtttgtttgcttgaatacaaatgtttgataagtctttttctgccccagtggcctgtttgcctgcctgaggagttacagttttgtcattgtgggagaaggggtggggggagggggagcctgcgaatttgaacggggtgagttgtttcttttagtgcatttcccactgggtcttttgggaggcgtctagcgttcctgctggccctgggacaaagacccagaatagaactcgtagctcgtgactgcacggtttacgccacaaaagtgctcttgacatccgtgacaccgttttgactttttgtttttttcttatttaacatttccttaataaatgcaacatttaagcgttt

SEQ ID NO: 175122 - DNA, 1093 bp, Homo sapiens
  Payload ID: 14386
  Gene Symbol: RPRML
  Gene Name: reprimo-like
  Uniprot ID: Q8N4K4
  ENST ID: ENST00000322329
  CDS Start-End: 242-604
aggttctccggctccagctcctgcgccgcctgttgctcgctcctccgggcggtcgcttcccgcccggtgcccaggggtaggcggcccgagagcgcgcaggcagccagcctcccgccttcgtcccctccccgtaccgcaggagccggtccgaggggtccggagcgtccctgagagcgcggaccccggcgagcagcccagtgcacccgggactgcgcgccgagacccccggcgccgcgcggcgatgaacgcgaccttcctgaaccacagcggcttggaggaggtggacggcgtgggcggcggcgccggggccgccctgggaaaccgcacccacgggctgggcacgtggctgggctgctgtccagggggcgcaccgctggccgccagcgacggggtccccgcggggctggcgcccgacgagcgcagcctgtgggtgtcgcgggtggcgcagatcgccgtgctctgcgtgctgtcgcttaccgtggtcttcggcgtcttcttcctgggctgcaacctgctcatcaagtccgagagcatgatcaactttctggtgcaggagcgccggccctccaaggacgtgggcgcagccatcctggggctgtactgagcgccatctgggtccgccctcgccagcgctgctgcaagaaggaccccggagacccggaccctcgccccgctctctgcgctctgccgccgcctccgggcgggcagctacgtgcctggggcgcccgggcggggacgcggcgagactgtcggcgggggcgcgggaagggacttggacgcccggctctgtcctgtgtgcgctgcagcgttgcggggtgggagaatgtggggtgagggttcttaccagttttttttgtttgtttgttttttaagacgttcggggcagggtgggagtgggtatggagatgcaatttgggactgcggtcgctcgcgtgggagttttgtgtgtacgttggtgcgggtgggttcggaacacggtgcgagtgggtgaagatgtgaagcgtcagagtcgctgagcttgttggcctgatcttgcgtttggaaagaaatcttgtaataaaactgcagccgtagggcttcaggcagcttccca

SEQ ID NO: 175123 - DNA, 11350 bp, Homo sapiens
  Payload ID: 14387
  Gene Symbol: RGMA
  Gene Name: repulsive guidance molecule family member a
  Uniprot ID: Q96B86
  ENST ID: ENST00000329082
  CDS Start-End: 273-1625
agttgtctcccgagcgctggctgcgccgcccgagccgctgggccggggaagcactggccgttcgctcccgggccggctccgccaggcgctcgcaggcatgcagcccgggagcaggaggcgctccccgggccgctgctgagccggccggggcggcggggaccagcgccagcggagcccctcccaccttgccccggggcagacgagcggcgccccgacaccccctcttctcccgcagccccgccagcgccaccccccgcgggccgcaggggctcatgcagccgccaagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttcttttagacgtgttggagtttgttttctgaacagactttggctcccttgaggcgggtggaggatggactttggtggtgggatcccctgcagcaagtgtgtgtgtgtgcgcgcatgtgtgtgtgcgcgcatgtgtgtatgcatgcctgtgtgtgtgcgtgcctgtgtgcgtgcatgtacgcatgtgtgcgcatgcctgtgtgtgcgcccatgcctatgtgtgtgcatgtaggcatgtgtgtgcgcatgtgtatgtgcgtgagaatggtgtgaaggcggatagaagatgcagcagtttaacagccaccacacattgcttttgtaaagtcacttttcctcctcacgatgagctgtctttggagcttggcaggcccagatcctcttgttctagtgacagtggaacacagtcagggagacaggtgactatgtggtggagagacatatggtgccctctgggatgagatgggtgggatagcctgagatctgggatgactccctctcagccactgctatcagcctggagccccagctgttgggactgcctgccaccctccctgccagtgcccatcttctcatagcccgggcggagcagtggtgctgcaggaggctgctgtccacgtcactgtgggaccaggtttattggcagctgtgatcacatttcatctgtacaaactacccagtgaatcaggaagaaattcaggcccattttgccgatgaaacagactctgagattaactgacttgcctagggctccttagcaacgggaaggacaacctgtgcacctaggttagtattgtcctgaagccccttctcttcaaactaaatgccatgaggcagaatagcagcacagttaagccagcctacatcctggcttctccacctccccagcagtgtgaccatgggcaagtcacttcacctctctgagcctgcatgctgttctctggaagatgggggggtgcctgtcccatacagttgtttggagagtcaggagttcattcctgtaaattgcttaggagagggcggggcacacatggcttgtctggtcgtggggagggagggggtggtattatcccaaagcaagataaatcagttaaggggagaaggaaaggggcgatacagaccctggactcttgggagaggtgaacctgcaggctagcaaggggaggagtcccaagagtggccaagttcattaatcccaggcagaccaggaaggctgaagaaaaaggagaactttattttatttttgaaatggagtctggcgtcttgctctgtcgccaggctggagtgcagtggcaccatcccagctcactgcagcccctgcctcccaggttcaagcaattctcctgcctcagcctcccaagtagctgggactacaggcacacaccaccacgcctggctaattttttgtattttagtagagatggtgtttcaccatgttgaccagtatggtcttgatctcctgacctcgtgatccgcctgccttggcctcccaaagtgttgggattacaggcgtgagccaccaccgtgcccggccaaaaaaggagaacgttctaaagccctgttcttgcagggctcccagagagaacacgggagttgggtttgggaggcaggaaccagactggaaaggacaaaacgtacccagcatcttccctggcggccggaaccgtcactacaggccccgtgcccttagcagtcccagggacagagcgactcagggaggcagcaaggaggagcggagccattggtgctcgtccggcacagagaacagttcctgagaagccagggcacacagaagaaaaagaaaaaagaaatctctactagacgaaaatgctaaatggcactagccacaaagtattcttggtttggaattttttttccaggaccctaaatgtaaccggctggaattctttcccaagtgccatgctacttactactggttgccctcacgagcatggaaatgccgtcgtgaatatggaacacagcatcctgagctaaaagattcccaagaagcagcttcatcttgcaggacgggctaggttgggagcctctggaggttcctggctgccagctccgcggaggcctgcggcctggaggtaaatgcattagcacacggaggtgggcgcctctccccgccccatcctgtctcactgatgtgttgccgagaactggagttcttgtttagctaaccagaatgtgcaaggctataggacaggagagaaatggcctttaaaacaaatgaatgagagtcacgatgaagggggcagacgggggggtgaaaatcattaccagaacacttgggcagagacccgtcagagccaggcaggagacagtcatcagagctgtgccagcaagtggcatggagcaggggtggcacttgggctcgggctgcaggcaaacttggcgtcaaaactggctcaacccgtcgcgagctgtgtggtctccttgggattttttgagccttagattccttatttgtaaaatggatttgtgagtctccacctcccgaggtcagtatggaaatccagtgagctaacactcgtcaatggcctcgcacatggccctggcaccacgcatggaggccgccaaaagtggccgcctcctctctgcaattgcatttatttatccatttgataactctattgggtgtctacccagcattgttcaggggggtgtgaggggctaccgcaatgacccagacagactgctgtgcattcttattggaaagacaaggcaataaaccacagttacaaaacccagggtcccatggtaacgagctccacagagaaaagggaagtgggccagaggttccgagagacacacattttggattgcaggagggtgagaaggggcattcatctgtggtggggttaaggggaggcctccgactagctcacctgcatgaatttcaggaacaagccatgcagagccggacagagcattctgtgcagagaaaacagtgtaacagccctagagcagcagcagcaaagggggagtttaagggatggtgggaagccactgtcactggacagtagcaagtggacagaccaggggtcccaggtgaggccacagagcagccaaagtactgcagggctctccggctccgggaggacttgatgtttgactccagttgccagaggaagccgttcacgggctttgagtgtaggaatgatgtgtccgacttgggtctttttattgttcttttttagagacagggtctcactctgtcacccaggctggagtgcagcggcacaatcacagctcactgcagcctccacttcctgggctcaagcaatcctcccacttcagccactcaagtagctgggattacaggtgcctgccgtcacacccggctaattgttaaatttttttggagagacaggatcttgctgttttcccaggctgatcttgaactcctgggctcaagcgagacgtctgtttcagcctcccaaagtgctgggataacaggtgtgagccactgggcctgccttggcttgggtattaaaggaattgttctagttactatatggaggtgacttggggccgctggggaagaaagaggaagtcaggagccagtctgaggcagtggcaatgcagcgattatcagaaataatgggctcaatgatagactggataaagaaaatgtggcacatatacgccatggagtactatgcagccataaaaagggatgagttcatgtcctttgcagggacatggatgaagctggaaaccatcattctcagcaaactaacacaagaacagaaaaccaaacaccgcatgttctcactcgtaagtgggagttgaacaatgagaacacatggacacagggaagggaacatcacacactggggcctgtcagtgggtggggggctgggggagggagagcatcaggagaaatacccaatgtagatgatgacgggttcataggtgcagcaaaccaccatggcacgtgtatacctatgtaacaaacttgtgcgttctgcacgtgtaccccataactgaaagtataatcataattttaagaaaagaaatgatggcctttggggtctaataagaaggtggggctgacagggcttggggagagagcgagcttgacaggagaccacgatgtcttccccaggggtctgagcacctggggaaatggtggtgccatttaccatgactggaaagatcatgggaggagcaggtttgggacactgaaggcccgagagcccctggcaaaccaccagtgtaagtccaagagtccaaaagctgaagaacttggagtccaatgtttgagggtaaaaaacagccagcatgagaaaaagatgaaggccagaagactcgtccagtctagcccttccacattcctctgcccgcttttatcctagcctcgctggcaggtgattagatggtgcccacccaggttaagcgtgggtctctgtctcccagttcactgactcaaatgttaatttcctttggcgacagcctcacagacacacccaggaacgatactttgcatcctccaatccaatcaagttggcactcaatattaaacagtttcggccgggagcggtggctcacgcctgtaatcccagcactttgggaggccaaagcgggcagatcactaagtcaggagatcgagaccatcctggctaacacggtgaaaccccatctctactaaaaatacaaaaaattagccaggcgtggtggtgggcgcctgtagtcccagctactcgggaggctgaggcaagagagtggcgtgaacccgggaggcagaacttgcagcaagcagagatcgcaccactgcactccagcctccagcctgggcgacagagcaagacaccgtctcaaaaaaaaaaaaaaaacaactaacagtttcgttcattaaggcaatgtccatggggcagctcctgcatgccacgccacccctgccctgacatactcccaggctgaccagccagaactggggagagggcatcttgaagaaacagtccaccctccgccctcgcatacctgtgtctcccagcagacaagacacacaagggcagggactgcactttcctgtgtgcaaatctcaggtatggtccagaaatcacatctctttggtctgattggccttacttaccaaacccttgaaacaatggaaagaagcttgctgcaatgggaagacccctgccccccaaaccctctaaccaggagtctacagacctcattccgtggaagttcccattgtcccctgggaaaccaccaccttctgaatcggcacagccaaggcccccaaccctgctatcaacagctttccttagccaccttccccatcctgcagggcttttcaacatttcgactttttaatccttccctccctaagatatagacatggtgttagtagcagaaccctgaaggcaaaggaacagaaactaacactctcagaaagtcctagcaggatggtctgaattaatagacagctgcaggcagccagtgtgcaaggcacgctcgtaatgtcagtggcgttccggaatgagggctgtgatcccaggcagcccagatcccaaggcgaaaacattcatgtcgcccagcatcaccctgtccttgcccagggtgaccctgagacggcacttggattcttccacatctgaactcaaacctgctccctcagctctccccagcaggaattggagccctctccaggccgttcagccaaagcagaatgtgtctggccaagcagatctgcccagagaagaacaaagacgtgttcagacactgtctggggaattggttttgagctcactctgagctccatctgtgcaacaaggccagcgtcagctgttacagagaaggggcttgtggcagtttattaccctggtgagctggctcggggccatgctgaccgcaggactgtaaaggacataaggcagttggcaatatgggaagcagcagtccccaaagcaccccgtcaaggaaacgatgcaagagctctgtccactggaccagccccaccctaccccgccacgccctggcctagggggagggaccttgtgtttcacgggcctggatggccagggatggacagtggcatgggcacagacacacccagaccgaaggaagggcccgggctccagaaccagacccgatccaggctcccagctctgtcacctactggctgcatgaaaagggtgggttttccttgttttgcagcctcagctatctcagctgtgagggaacaatgacgccacctccctcacgtggcggtcctgaagatgaaatgtaatgcatgcagcgcggcggccggcccaccgtgtgctcttagtaactggccgctgttctcttcagccctcccgttactgaccacctcgagggcaccgttcctccaagctgaccatttcctgccagtcacccactgcccagctcgcccagccatggagtgggctctggtccacgtgcatggtgagctgccatctttgtcgtcctctggacaccacgtctacctccttgggaaatagaaacgagtcctgcattgctttgtcaaatttcacaaaaaccctagaaagcagatattgccctggtttacagacggacagacagaagcaaagagaagccaactgacccactccaggttacaagcagggtctggtaggagagcacgcgtccaccccaccgctcactgcgcccacctactcctcgcttgagggcagagaacgagctggggcggggcgctccagggggcacaggcagcctgtgttcaaggcatgctcgtgagccccacagcaggggcggagtcaaaccagggctctggttctggggtgagcagagggtggggccaggcccccactgggaggctgactgaggaggggctcaaagggcaggcaggctccatcagagcggtttgatgagcagggccgctgagtggccctcaggtcaaggctggggccgggaccaccagggaccaggtctgcggggccaggggtccctccccagggtggagcaggaaaactccggcaaccgccttcttgagtggacttgaccttccctttctctgctaatgatctcagattaatcccttaaggcaagtgccccagggtgggtgttggttgcataaaacaagaggagtccttcttcccttccttcctggcacaaacatttgtaggccacccccgatgtggctggtcgtagtctggatttgggggcacattcaggcattcaacaaatacgtcatgaggccccgtgatgagctggggggctatgcttgatgtcggcagtacagctgtggtcgctcgaatgaatgtgcccgccctcacgggactgacctctagtggtgagagacagacactaaccgagtcacatgtgtgattacacgtgtaatcatacttacatatgtaacaacacgagttacacgtgcagtgtggggagggggcccttcacggtgaccagcccatcagggaaggggatgcgggtggcagaaggaagcggcacacccttgtcctcacggagctcacaggaggttctctgaccctcatcttaagccacaggctgtgtctgagcctcactgccctagctatcaactgggtgcaggactaggccttaatcactgggcagcgggaagaactacataagctcatactggcgcaaagccccttgggagaccgcagggaaagccattgcatgaggtggtgacaggctcggccttcagagtcgggctagaatctgagttctgacaatgatccccgccttgacccatctctcctcaggccgccctgagccttccagttaggcctgggctttgggcttccgtgtttgtctctggattgttcggttttagcaagagtcctgctaaattggtcttgctggaatcctccgccctccacatctgattgcccttcctgtctgatcgtggtcttcatgccccacggcctccaggggacgtctgatcacctggcctgccttcagcaagaatccccccaggtgtttcctcttaagaggttttccatccactgagcccaccctgctccttggccatcaattcccacttgcctgtactgtattcagaggggaccccaatctctcttcccagctgcagcggtccctgtccaacactgccccccacctcaaataaagtctttcttactgtctttaacatatgccgtcaataaagttttagcagatcc

SEQ ID NO: 175124 - DNA, 3078 bp, Homo sapiens
  Payload ID: 14387
  Gene Symbol: RGMA
  Gene Name: repulsive guidance molecule family member a
  Uniprot ID: Q96B86
  ENST ID: ENST00000425933
  CDS Start-End: 182-1486
gtagctgagatgcagagagccatcctgcccagacctagacaactcggaagtgggtttttcagcctcctgcaccggtgtcgcgtctgagtgcgactgatgagccagggggcgtcggtggaagcttggggtcggcagtctggttggaaaggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttctttta

SEQ ID NO: 175125 - DNA, 3038 bp, Homo sapiens
  Payload ID: 14387
  Gene Symbol: RGMA
  Gene Name: repulsive guidance molecule family member a
  Uniprot ID: Q96B86
  ENST ID: ENST00000542321
  CDS Start-End: 152-1456
cgcccgcggccgaggtggacggagcctcccggctcgctgctcccgccggcggagcgaggctgccctttcttcgcagcgtgatttattttcttctttttttctgaactcttcttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgtta

SEQ ID NO: 175126 - DNA, 3174 bp, Homo sapiens
  Payload ID: 14387
  Gene Symbol: RGMA
  Gene Name: repulsive guidance molecule family member a
  Uniprot ID: Q96B86
  ENST ID: ENST00000543599
  CDS Start-End: 278-1582
ctcccgctcgacgcccggctgcggagctgcctggccatctcctgccctcggggatgtcggcgcagtgcaccgcgtgggctcgcgtcccggcggccctttgcctcggcgcgccggcgtacgggaaggtgcggaccttggattgagggccgaggatgcccattgccaagccgccccggctttcctaagtggacgggagggcacggcgacgattcagcgccggctcgcgccgcagctcaacccaggggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttctttta

SEQ ID NO: 175127 - DNA, 3172 bp, Homo sapiens
  Payload ID: 14387
  Gene Symbol: RGMA
  Gene Name: repulsive guidance molecule family member a
  ENST ID: ENST00000554387
  CDS Start-End: 132-317
agacctagacaactcggaagtgggtttttcagcctcctgcaccggtgtcgcgtctgagtgcgactgatgagccagggggcgtcggtggaagcttgggggagaggctagtggtaacaggccgagctggatggatgggtatggggagaggggcaggacgttcagccctgggattctggccgaccctcgccttccttctctgcagcttccccgcagctattaaaagaagcccaggaagtttctgcgcagcgttggagatgaggagactgtggaatttgatgtcgtggaaggagagaagggtgcagaagccgctaatgtaactgggcccggggaggtgcccgtgaagggcagctgttatgcccccaacctacccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgtt

SEQ ID NO: 175128 - DNA, 547 bp, Homo sapiens
  Payload ID: 14387
  Gene Symbol: RGMA
  Gene Name: repulsive guidance molecule family member a
  ENST ID: ENST00000555598
  CDS Start-End: 278-547
ctcccgctcgacgcccggctgcggagctgcctggccatctcctgccctcggggatgtcggcgcagtgcaccgcgtgggctcgcgtcccggcggccctttgcctcggcgcgccggcgtacgggaaggtgcggaccttggattgagggccgaggatgcccattgccaagccgccccggctttcctaagtggacgggagggcacggcgacgattcagcgccggctcgcgccgcagctcaacccaggggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcata

SEQ ID NO: 175129 - DNA, 1929 bp, Homo sapiens
  Payload ID: 14387
  Gene Symbol: RGMA
  Gene Name: repulsive guidance molecule family member a
  ENST ID: ENST00000557301
  CDS Start-End: 373-1749
gtttcatccaaaagatgtctctcaggggaagttaccagtcccttaaatatcacaacggcagcagaactgcagggcccagggaaccttgggaaggagatgtttctttcccagaaaaataagcgacagagttaggaaaggtcaccatactgaagccctcccaagtgcagccttgcgggcctcgcagagagcgccaaaccatccggccctgcgcgccacgcggaccggcatagccatctctctggagtggcagctgtgccaaggtggcaaggttaggcccgcaggccctcagcacgggggcgcagccggggcaagtcttcaggaagcagcgaggtgcttgaagggggtgctggaggcaggccaaacccagtcaggatgggtggcctggggccacgacgggcgggaacctcgagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaagg

SEQ ID NO: 175130 - DNA, 989 bp, Homo sapiens
  Payload ID: 14387
  Gene Symbol: RGMA
  Gene Name: repulsive guidance molecule family member a
  ENST ID: ENST00000557420
  CDS Start-End: 149-289
ccgcggccgaggtggacggagcctcccggctcgctgctcccgccggcggagcgaggctgccctttcttcgcagcgtgatttattttcttctttttttctgaactcttcttccagggagaggctagtggtaacaggccgagctggatggatgggtatggggagaggggcaggacgttcagccctgggattctggccgaccctcgccttccttctctgcagcttccccgcagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatg

SEQ ID NO: 175131 - DNA, 320 bp, Homo sapiens
  Payload ID: 14387
  Gene Symbol: RGMA
  Gene Name: repulsive guidance molecule family member a
  ENST ID: ENST00000556950
  CDS Start-End: 290-320
acacgtcccttacaccgtgtgcgggctgggagctccttccctcagcccggctcgcggagccccggacggagccggccacccgactgtcccgccgtgaacccccattggcccgcgccgcccgggcccccgcctcccgctcgacgcccggctgcggagctgcctggccatctcctgccctcggggatgtcggcgcagtgcaccgcgtgggctcgcgtcccggcggccctttgcctcggcgcgccggcgtacgggaagggagaggctagtggtaacaggccgagctggatggatgggtatggggagaggggcaggacgttcag

SEQ ID NO: 175132 - DNA, 1889 bp, Homo sapiens
  Payload ID: 14387
  Gene Symbol: RGMA
  Gene Name: repulsive guidance molecule family member a
  ENST ID: ENST00000556658
  CDS Start-End: 822-1847
aagtgggtttttcagcctcctgcaccggtgtcgcgtctgagtgcgactgatgagccagggggcgtcggtggaagcttgggggagaggctagtggtaacaggccgagctggatggatgggtatggggagaggggcaggacgttcagccctgggattctggccgaccctcgccttccttctctgcagcttccccgcagacagctattaaaagaagcccaggaagtttctgcgcagcgttggagatgaggagactgtggaatttgatgtcgtggaaggagagaagggtgcagaagccgctaatgtaactgggcccggggaggtgcccgtgaagggcagctgttatgcccccaacctacgtaagtttcgccgattcatcccccggcctccctcagttgccccaccacccatggtggcagagatcccttcagcggggacagaacctggcagagaaggggaacgggccaaagactccgcgcagcggcccagacgacggcgccccccacccttcttctaccgacggtggtttgtgcgagtccctcggccccccagccagcaacagcctacagagagcactgacggggtagagcccaaagagccccattggaggggcagcaacagcagggagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggc

SEQ ID NO: 175133 - DNA, 4580 bp, Homo sapiens
  Payload ID: 14388
  Gene Symbol: RGMB
  Gene Name: repulsive guidance molecule family member b
  ENST ID: ENST00000308234
  CDS Start-End: 403-1839
atttgaggctgactggggagaaagctgcctggaggaagctgctggggtgcggggggctgagggatttggctccccgccctctcccctagatggcggagaaatcgggctagctggaagggcgcagctcctctcccagagctcattctggagtcggagaactgggagagcggcccccgaggcggagcctccctcccgccccgagtcgcgctgccccccacctgggggagaggggcgggcgccgcgctgccttccctccgcgcctcggccgcgtggcttgcggcttattttcccagctggcaagcgtcgcgctgcagacaagggaatgcctgtggtcctgcgtgttccgaagttcaggggccccctgatcccgctgagccccctccaggagcgaaagggttaagaatgataaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgcagccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtgcttggttgatatgtatagtacatatacacagacatccatatgcagcgtttcctttgaaggtgaccagttgtttgtagctattcttggctgtaccttcctgccctttcccattgctactgatttgccacggtgtgcagcttttactcgccaccttccggtggagctgcctcgttcctttgaactatgccctcacccttctgccctcacttgatttgaaagggtcgttaactctcccttacaggtgctttgactcttaaacgctgatcttaagaagctctcttcatctaagagctgttactttttcagaagggggggtattattggtattctgattactctcaattctaattgttatatatttgagcccatacagtgtattaggttgaaccatagaaactgctattctcgtaggtcaaaagggtctagtgatggaagttttgtagataagtaccaggcatctcagtaactcctagactttttctcatcccatgccccgttttaaattgtcagttttccctctgactcttctgtgttaaaacatgaaactataaatttagtaattatcatgccttgctctttttaatctatatgactgatgcaagcccctcttcttaaccgtttcttggctttgagcccagaaacacagctctccctgtctccaactccagtaagccctcctcagcctcaccttacgaatccaaagaactggggtttgttaggttctttctctaatgtagaggcccagatcccatcacaaagtttttcattcttccttgtccaccatgatcttcatcacagtctttgatatgtctgcatgcaaagtggaacagagttgggcggcaatgacagaagagcttccttggcctgactcggtgtgcggccacttcggcactgcttaatccagatattcttgttaactaagcattgtgcttcccaggtggtctgaagtcaggtactctctctctcaacacctgtagttgaatatgatttggtcagttgctcgttgtaacttggagaaattcctataaagtaagatctccttgcctcttccatccattgttggcacccccttgcaaaaggaaaagaacagcaaaagtcaggagcagtaatctgagaaagttaactccaggataggtaggtttctattgttatagctagatgtaaatctttagttccaagaagtgatagagtttctgctttaataatttgttgataagtttacataaacagaaataaaagatactatctttaccgtagtagttcaggccaagattatgcttagttttagttctccaggtagttacttttgccatgtcctattgatcagtgacactgccagaggcccataccggcaagaggaagaggacgtcattttgtaaagtttaacttcttagcgaactgatgtgccacccagtcacagagtggagttgtgaattcatgtagaggtggcaaacctctaccttgtgttgatgagagaataatcttgggcagtctgggaaaataaggaaggcatctccttcttactcatggagattcaactatagagagttgaaacctaaacccgccttccttttatagaagctggactagagacggactgaccatcagctctgaactgtggctttttttgttcacctatgatgccatgtaccaaattcagaagctatcgttaataatttgttttataattgagtagtacaagcgaggaaaaaatacggaggataaccactatttttgtgcaaataatatgaaagtgaagtaaaagcaatagaagaaatttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttaaaagactcaaaacttttttttgtcctctttgttatgcttggaagctcccccccccccaacagtgtgtcgagtctttgcaaagaaacctttagatgtggttcatagatatatgaatacgtatctgtgtaaaacagtgagtgtgcagtgtgtaaatactttaaattattatgctagaaaaataaagttacataccttgctgtggaa

SEQ ID NO: 175134 - DNA, 2052 bp, Homo sapiens
  Payload ID: 14388
  Gene Symbol: RGMB
  Gene Name: repulsive guidance molecule family member b
  Uniprot ID: Q6NW40
  ENST ID: ENST00000513185
  CDS Start-End: 437-1750
gagattgatcgaccgcgggggctgccgcgcagagatatccgggccgccggtgggtggtcgctagggctgggccagcctcttggaggtccacgcccgccgagcccacgctggctggggccggggtgccggcgcgctcgggactcgtctcagcagtcgctcacggtctttgtgtcttctcttccgcccctttccctgcctgccgcctccggccgccacgatgcccctgcgccccgctgctgccgccgcggactggctgcgccggctgcgcgctgcttgctgcggcggtggtggcgccccatctgctacacgggcctgaagaaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgcagccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtg

SEQ ID NO: 175135 - DNA, 1413 bp, Homo sapiens
  Payload ID: 14389
  Gene Symbol: RMND1
  Gene Name: required for meiotic nuclear division 1 homolog
  Uniprot ID: Q9NWS8
  ENST ID: ENST00000336451
  CDS Start-End: 316-1032
atcaactttaaagatattttaaacttgatgaagacttctgaatctatcagaaaacaggttagaatgtctgtcttcaagtcttgattctgaaaagtagcccctgagcctgtttcattttggctgtgtttttattactgtgcagctgacaccccttggaaaggacctaatgcactgcacagcatttgcaacggcagatgagtatcatctgggaaatctgtctcaagatctggcctcccacggatatgttgaagtaacaagcttgcctagaggtacttcttcttgaacctggggccaaatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgttca

SEQ ID NO: 175136 - DNA, 1854 bp, Homo sapiens
  Payload ID: 14389
  Gene Symbol: RMND1
  Gene Name: required for meiotic nuclear division 1 homolog
  Uniprot ID: Q9NWS8
  ENST ID: ENST00000367303
  CDS Start-End: 124-1473
gagatgggttggctgcagtagtgagaggctgggggtgcggctctttccctgcagtcctgccgaggaagcgtgcgtccctggcgcttccttcttctcttccggcggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgttca

SEQ ID NO: 175137 - DNA, 743 bp, Homo sapiens
  Payload ID: 14389
  Gene Symbol: RMND1
  Gene Name: required for meiotic nuclear division 1 homolog
  ENST ID: ENST00000444024
  CDS Start-End: 111-743
gggttggctgcagtagtgagaggctgggggtgcggctctttccctgcagtcctgccgaggaagcgtgcgtccctggcgcttccttcttctcttccggcggagaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaac

SEQ ID NO: 175138 - DNA, 1484 bp, Homo sapiens
  Payload ID: 14389
  Gene Symbol: RMND1
  Gene Name: required for meiotic nuclear division 1 homolog
  ENST ID: ENST00000622845
  CDS Start-End: 173-1012
ggaccagagttcagtgcggctgcgcagtagcgggggtgggcgggagcgcccttccaggagatgggttggctgcagtagtgagaggctgggggtgcggctctttccctgcagtcctgccgaggaagcgtgcgtccctggcgcttccttcttctcttccggcggagaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgttcactactgggtgatcatttaataggtgtttttttaatcaagaaattatctttttcagcccagtatatcgtgtgaataaaattatgaagaatct

SEQ ID NO: 175139 - DNA, 6301 bp, Homo sapiens
  Payload ID: 14390
  Gene Symbol: RMND5A
  Gene Name: required for meiotic nuclear division 5 homolog A
  Uniprot ID: Q9H871
  ENST ID: ENST00000283632
  CDS Start-End: 496-1671
cgcgtgtgggcgcccgtcgcgttcctccgcccgttctcgccgggtcgcaccccccaccccgagggtgtacttggtacggcccgcgccgcctcctttcctcgcccgggtggccatccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggagccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggtggggcccgggccgaacggctgcggacacctgggcgccgaggagccgagcgccgccgcctccggcatggatcagtgcgtgacggtggagcgcgagctggagaaggtgctgcacaagttctcaggctacgggcagctgtgcgagcgcggcctggaggagctcatcgactacaccggcggcctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataagaattttgattctgacattagcagtgtgggaatagatggctgctggcaggcagacagccaaaggcttctcaatgaggtgatggtggagcacttctttcgacaaggaatgctggatgtggctgaggagctctgtcaggaatctggtctttctgtagacccaagtcagaaggaaccatttgtggagttaaatagaatattagaggcattaaaggtcagagttctgagacctgctctggagtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagtttgataaattgaattgtggttatgaaactaatttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagttagaagtgttcttaagttgatatttactctcttggtcttggtagccctattatatcattgcagacacagtgttgtgcatgtgtgtattgtatatgtgcaccagcatcaaacattgtgtatctggaaggaaagcagcatgttccagttctaaaatgcagttaccagacccatcactttaaatccttaaagttagaagctagcaaattttctgtagtgcagaacgtttattgctgtttttgtgtttgaatagtataatgtttgatgcctctcttctgcaaagcgtatcatctcattgactgtgaatctgtatattattctgatggatacagataatgatcttttctcttgtgaggtatcttcatttatgcactgtccaaaaatagccatgtgtaagagtctttctgtatgacgaactacatggaaaagacttctgtggacataattctgaccgaaacccatgaagttacttcagtataagaagaacgttacacggaaatcaccaaatattttgcaactttatttcttctgacatggagtgaacatcaataggaatactttcaaagaaaatgaaaacacagaagcaaagagaaatgtggcacttcacattttaaactacagatggacttggtttgagggagggggaatcacagatttggtgctaagttaattagaaactggcagcgttttacagtagtacaccagcctggatgttttttctaaaatgtttacctgggagagctggggtttgtttgtgaggagaaagagtactgtggaaaacctctgcttgagtaccatgtggccaggcctatgtggatggctactccgtgctgtgcggcttcaccagcggttgggattggcccagcttggagtgcttgtgtggtccaacctcagtctggccccatagcgacttttgccccatgattctgcttcactgttggaatcctctttgaagttccccctctctttgctaaagcagtgaaggaagagaacagagacaaactctttggactgtgaaagagaaggtagagaattccaggcaacagtctgaccaagggtgtaaaccagtttattatatatatatttttcctttgaattaaaacctagagtgttgtatttttctttctttctttttttttttttttttttttaccctttttctccttaggccaagtttagcttattcttatctttccacccaaacacctacacaacgtttaggcttcctgtaaggtttgaatgagacagatgtactctgaaggctggtggtaaatgtgtttgatgaccagactcttcatacagtcggcttgggccactttaaaggacaaaagccagagctcagctttatccctctcccagtgctgggagccaaaaaactgttgacggttttttgtgcagctcaagaaaactttgaaaagaacatgctttaactgaagcattggactctgcagctttctgtgtaaggcccgtgtactcccactgggcagggtgaggaccaaaaatctgaaactcttatgaatctgacatattatatggaaattatatcttgtgaccgtcttcaagtgcatggacttaaaattcatgagagactaaatgtgagggagaggtggatttaaagaggccagaccttaaccaaagatgctgagatacagcattctgtcccccctgccctagaaactccataaatgctgtcacaaccctatcatcgctgatgctttctgcatgtcagcagtccaggaggatgctttttgtctctctttgcctccactttacaaaagataatatgatagaggcaacgtttataacagtcacatttaattataatgtacatcaaaggcagaatttcagaatggtttcttaaatttccttgggaaccgtttccacatatcagttatagacaaaggccatgggactatgctaaaccaataaaaccttattagcaaatctttagattctgacttagccagagcatctgagtgttcaagtacagttttacagtggctaaggttgtctcttgatcttttttctccgttgtgtgatcacagatgctatttctgttttattggtgattatacgagacttctaatacataaatgaacgggtattggtgcctctttattttaaaaaatttgaagaaaagagccacctcatattcatagggtgtgtattttttgagtgtgagcatttaattgaaaataagaaagctatgaagtaaatgttaacttctctgtagcagctaatgcatagagacactaaaacccacaccacattttgtgggaaatgaggatcctgatcctcttttgtcctctccaggtagtctcgcaggttatgcagcttaagttcagtcttctttatgctgcgattgatttccacctcagtggcttagcctttgggacagtggatactgcaacagccaagaactcttggttatccgcacaagctgctggtagactacattagccctctggttttccagctcaacctctgataaagtggactgagagccacgctgctcagtctgtttcgtcagccgactcaggttattttcagggaaggcatggaggcatagtttggttagtttcatcactaggatgtataaggtgacgacacaaaccaaatacctttctttcatcacttaactatacgtactttatctctggtaacactagaatgctgtggtcttgagggaatgttagcaaggaacacatagaagatttggtgtttcataagcctgtctaggtgtggcaggttttgtgtggtacactgatgtttaccataagcaggtacaagcttcatgaaccgttcttaatgaactataattgaatagataccaaaaatagaatgacaaatgtattttaatagcagatgaggcagttttaggatgaattttccactgttgattttacttcaagacatagcaagagaaacaaaattttgttttcaagacatttccactgcagtttcaagctgtagtgggcatatgcttcatttacttccaaagaggcaaaagcagctggaattggcttacagcacatgctttgtttcatgttatgggtgaggacctacatacactcttactttagcagtcacttaaccttctccagcaaggcagttgtggggttcactaggatttagtgcctgatcttttttttgggaaggggcgggaatgaatgtgttggggctgggagggaagcagaagaaaatgggagtgtgagtgagtgtgcatgtgtctgaagttcaccattgcccccacctgcacctagcaaggaacaggtgtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtatttctataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaacacaaaccacatccatatcctctgttcatttgattttggaaaaagtagcatatccagtagtttcagggaattcattttaactttaagaattctgatatatttaatttataaatttcggactgatataatagagttttggaaaactataagaaatgctttgttaatgtgtgtattcctatgtaaaacacatggcttttcctgtgtatatttttaaaaattaaagaaatgcacatttaaaaagtg

SEQ ID NO: 175140 - DNA, 1929 bp, Homo sapiens
  Payload ID: 14391
  Gene Symbol: RMND5B
  Gene Name: required for meiotic nuclear division 5 homolog B
  Uniprot ID: Q96G75
  ENST ID: ENST00000313386
  CDS Start-End: 212-1393
gcggcttccggttccgatgacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatt

SEQ ID NO: 175141 - DNA, 4066 bp, Homo sapiens
  Payload ID: 14391
  Gene Symbol: RMND5B
  Gene Name: required for meiotic nuclear division 5 homolog B
  Uniprot ID: Q96G75
  ENST ID: ENST00000515098
  CDS Start-End: 352-1533
gcggcttccggttccgatgacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcagggtctcactcttgctcaggctggaatgcagtggcataatcatggctgactgcagccttgacctcccgggctcaagcagtcctccgtcccacctcagccttctgaggagctgggaccacaggcgtgtgccaccatgcccaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaactccataggagaaatccgtgtaatgggattcaggaaaatgaagtaacttgcacaacagggctcacagcttagaaaggagagagcttggagttttaaccagatctgaccctcaagcccaagctatttccagtttattccagggtgcctgaacttggctgttatgtatactgagtcctgtgcagggcctctgacagcaggaaggggccccaagtctaaaatacttgaagggattgggttactagggccattatgttaagcaagagagctcgggggaatgcattttagcttcatattcctatttaaaatgtgctgtgtgggtgggtaaattgcttccataagcttcacagtggcatttaaggctcctgggttaagttaggaatgggggtgttcctgatgtgggggctttaggcttccatgaagtgggtctgggccccctgccttacctcacagcccccatctaccctggaagagggagttgaaaatgctgggatagcagcaggatcagttctcagcttgagccaaagcacccggccctgggcagctgagcatcagcacagaaccctctgagtcctttgggctctctgctgaggaagactgcttcactcttcccgcccaccaactcgctggcccaaccagcagctgctgcttaagaaaacacccacagactcaccacattttagtcttagcatttactttccccaccccacattcttggaacagcctttagttctacaggaaatggcactgatggacagaagactagcattaccttcatgaaagggctgttagagctgcctgggaagaaggcgtgccttggggaactgggaagatgccgtcagtgtgggtgggcaggaggacagccagtcgtcctgctgccagcccaatagcttccagcggcaggtgcccaggtgctaccggagcccctcataggggtaggggcagggactgcacctcctccaggcactcatcgtaagcctcctggtactcctcatggggcttgaccattatcacacaggtggggcgcttggagcctgcggctgcacccaggtcctacagaggggaaagaagtgctgtttggaaaaaagctgtacaacctgtatgccaggaagtcaccaactgatgacccaccagcctaatctggcccacaaccatgttctgttcggtccatgttctatttaaaagcatcttgaattggttgccatcatttaaactcaatcagactttgaaggcatggtccagccacacagggcctacattcccacatggcaactatgaaagggctccagcccagcaggggctgtcccggtccctgccacccccacttcctgtgcctcagatctggcccctgttacgtaagataaggacagctacaggtccctctgagcctaaacccacctaaccggactaacatgggtgaagcatcttagcttacaaagctctttcacatacatctatctctttattctcatagtccacagataactgactatttggttcttaccatcaggccaaacggtaagttccttcagaacagggcctcctgctttatcccaagaagtgatactgtaggtacccaagatccacccccagcctctattttttttttttgagacagggcctcactctgtcatgcagtctggagtgtggtggtgtatgatcatggctcactgcagccttgaactcctgggttcaagtgatctcctgctttagcctcccaagtggctgggactacaggcatgtgccaccacacccagctaattaaaaaaattttttttgt

SEQ ID NO: 175142 - DNA, 738 bp, Homo sapiens
  Payload ID: 14391
  Gene Symbol: RMND5B
  Gene Name: required for meiotic nuclear division 5 homolog B
  ENST ID: ENST00000512663
  CDS Start-End: 191-424
agtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcaggtgggtggccacccttgcaagtgccctgcgacagcctccctgaggacatgggagacccgaagctactgagtgacagggttccggaaggacgatgatgaggatgttggtacctgcatctgtaggcctccttgaaaccggccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggc

SEQ ID NO: 175143 - DNA, 471 bp, Homo sapiens
  Payload ID: 14391
  Gene Symbol: RMND5B
  Gene Name: required for meiotic nuclear division 5 homolog B
  ENST ID: ENST00000512811
  CDS Start-End: 13-201
gctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaaga

SEQ ID NO: 175144 - DNA, 653 bp, Homo sapiens
  Payload ID: 14391
  Gene Symbol: RMND5B
  Gene Name: required for meiotic nuclear division 5 homolog B
  ENST ID: ENST00000502814
  CDS Start-End: 312-653
gacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggatggagtgcaatggcgtggtcttggctcactgcaacctccacctcctaggttcaagcgattgtcctgcctcagcctcctgagtagctgggattacaggtgcccgccaccacgcctcggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaa

SEQ ID NO: 175145 - DNA, 808 bp, Homo sapiens
  Payload ID: 14391
  Gene Symbol: RMND5B
  Gene Name: required for meiotic nuclear division 5 homolog B
  ENST ID: ENST00000507457
  CDS Start-End: 365-808
cggaagccggggccggggctgcggggcgaggtgagagcgggcgggcttgggagccggcaggtgcgggccgagggcgggcacagcggccggcggagctgaggcgcgcggcggggaaagctcggccggcctcccgggccccagccttctccagaacccctgctacccacgactaagccccgaacaatctgcccttgggcttgttctcttcgcagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtg

SEQ ID NO: 175146 - DNA, 562 bp, Homo sapiens
  Payload ID: 14391
  Gene Symbol: RMND5B
  Gene Name: required for meiotic nuclear division 5 homolog B
  ENST ID: ENST00000508647
  CDS Start-End: 393-562
ggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcagtggcctgtgaagctggtcctgggagtacctgtgatgtgaagtacgtagagaaggactctgaggccagagccagactgtctggcttcagttcagttcccagctcctccacttcccagacgcctgaccttgggcaactgatttaatctttgtgtctcattttctcatctgcaaagtgggtctaatcattgtacctacctcatagtgttttcgtgagcattaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccct

SEQ ID NO: 175147 - DNA, 1681 bp, Homo sapiens
  Payload ID: 14391
  Gene Symbol: RMND5B
  Gene Name: required for meiotic nuclear division 5 homolog B
  ENST ID: ENST00000542098
  CDS Start-End: 1-1143
atggctgactgcagccttgacctcccgggctcaagcagtcctccgtcccacctcagccttctgaggagctgggaccacaggcgtgtgccaccatgcccagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttc

SEQ ID NO: 175148 - DNA, 1147 bp, Homo sapiens
  Payload ID: 14392
  Gene Symbol: RERGL
  Gene Name: RERG/RAS-like
  Uniprot ID: Q9H628
  ENST ID: ENST00000229002
  CDS Start-End: 208-825
acagggcagtgtagttccagaaaataggactgaccaagaagcagaaaagcaagatgaatgatgtgaagcttgctgtcttgggtggtgaaggaacaggcaaatctggtccctacatccttaaataactgcaaatacttggtagtgtctttgtgactattacacatagtaccttgaagccagactgagtttgacagagaaaataaacagatgtcaaacttcttgcatctcaaatataatgagaaatctgtttctgttacaaaagcccttacagtgaggtttcttactaagcgattcattggagaatatgcttctaattttgaatctatctataagaagcacttgtgtttggaaaggaaacaactaaatctagaaatatatgacccttgttctcaaacacagaaagcaaaattctccctcacaagtgagcttcactgggcagatgggtttgttattgtgtatgacatcagtgataggtcttcatttgcttttgcaaaagcgctgatctacagaatccgggagccacaaactagtcattgtaaaagagctgtggaatcagcagtgtttttggttggcaacaaacgagatctttgtcatgtgcgagaggttggctgggaagaagggcaaaagctggcactggaaaaccgatgccaattctgtgaactgtctgcagcagagcagtctctggaggtggaaatgatgtttatcagaattatcaaggacatcctgataaacttcaaactcaaagaaaagagacgtcccagtggatctaaatcaatggccaaattgatcaataatgtatttggaaagagaaggaaatctgtttagtagacaggtaatcctgggagatttcctatatcagagagtttcaaacattcacatgataattaaactaacctttgtatgcaatttttttttggtaaaaagaattctcttggagatatgaaatgattgagtatgaaccacagctgtgttttcaaatatgtagtttgcctttttggttgttgtaccctgctcactctccttcacacagaacctttcatttattgtacaacatcacactcaccctaacctactggcggacagcgatcccagtttgccttgccaaataaactctgtttatgtgaatttattaaacgaccatgccata

SEQ ID NO: 175149 - DNA, 367 bp, Homo sapiens
  Payload ID: 14392
  Gene Symbol: RERGL
  Gene Name: RERG/RAS-like
  ENST ID: ENST00000536890
  CDS Start-End: 2-190
gatgaatgatgtgaagcttgctgtcttgggtggtgaaggaacaggcaaatctgcccttacagtgaggtttcttactaagcgattcattggagaatatgcttctaattttgaatctatctataagaagcacttgtgtttggaaaggaaacaactaaatctagaaatatatgacccttgttctcaacgctgatctacagaatccgggagccacaaactagtcattgtaaaagagctgtggaatcagcagtgtttttggttggcaacaaacgagatctttgtcatgtgcgagaggttggctgggaagaagggcaaaagctggcactggaaaaccgatgccaattctgtgaactgtctgcagcagagcagt

SEQ ID NO: 175150 - DNA, 973 bp, Homo sapiens
  Payload ID: 14392
  Gene Symbol: RERGL
  Gene Name: RERG/RAS-like
  ENST ID: ENST00000538724
  CDS Start-End: 50-664
ggcagtgtagttccagaaaataggactgaccaagaagcagaaaagcaagatgaatgatgtgaagcttgctgtcttgggtggtgaaggaacaggcaaatctgcccttacagtgaggtttcttactaagcgattcattggagaatatgcttctaattttgaatctatctataagaagcacttgtgtttggaaaggaaacaactaaatctagaaatatatgacccttgttctcaaacacagaaagcaaaattctccctcacaagtgagcttcactgggcagatgggtttgttattgtgtatgacatcagtgataggtcttcatttgcttttgcaaaagcgctgatctacagaatccgggagccacaaactagtcattgtaaaagagctgtggaatcagcagtgtttttggttggcaacaaacgagatctttgtcatgtgcgagaggttggctgggaagaagggcaaaagctggcactggaaaaccgatgccaattctgtgaactgtctgcagcagagcagtctctggaggtggaaatgatgtttatcagaattatcaaggacatcctgataaacttcaaactcaaagaaaagagacgtcccagtggatctaaatcaatggccaaattgatcaataatgtatttggaaagagaaggaaatctgtttagtagacaggtaatcctgggagatttcctatatcagagagtttcaaacattcacatgataattaaactaacctttgtatgcaatttttttttggtaaaaagaattctcttggagatatgaaatgattgagtatgaaccacagctgtgttttcaaatatgtagtttgcctttttggttgttgtaccctgctcactctccttcacacagaacctttcatttattgtacaacatcacactcaccctaacctactggcggacagcgatcccagtttgccttgccaaataaactctgtttatgtgaatttattaaa

SEQ ID NO: 175151 - DNA, 520 bp, Homo sapiens
  Payload ID: 14393
  Gene Symbol: RETN
  Gene Name: resistin
  Uniprot ID: Q9HD89
  ENST ID: ENST00000221515
  CDS Start-End: 89-415
accccaagaggcctcaaagaaagagctgcggtgcaggaattcgtgtgccggatttggttagctgagcccaccgagaggcgcctgcaggatgaaagctctctgtctcctcctcctccctgtcctggggctgttggtgtctagcaagaccctgtgctccatggaagaagccatcaatgagaggatccaggaggtcgccggctccctaatatttagggcaataagcagcattggcctggagtgccagagcgtcacctccaggggggacctggctacttgcccccgaggcttcgccgtcaccggctgcacttgtggctccgcctgtggctcgtgggatgtgcgcgccgagaccacatgtcactgccagtgcgcgggcatggactggaccggagcgcgctgctgtcgtgtgcagccctgaggtcgcgcgcagcgcgtgcacagcgcgggcggaggcggctccaggtccggaggggttgcgggggagctggaaataaacctggagatgatgatgatgatgatgatg

SEQ ID NO: 175152 - DNA, 249 bp, Homo sapiens
  Payload ID: 14393
  Gene Symbol: RETN
  Gene Name: resistin
  Uniprot ID: Q9HD89
  ENST ID: ENST00000381324
  CDS Start-End: 1-249
atgaaagctctctgtctcctcctcctccctgtcctggggctgttggtgtctagcaagaccctgtgctccatggaagaagccatcaatgagaggatccaggaggtcgccggctccctaagcttcgccgtcaccggctgcacttgtggctccgcctgtggctcgtgggatgtgcgcgccgagaccacatgtcactgccagtgcgcgggcatggactggaccggagcgcgctgctgtcgtgtgcagccctga

SEQ ID NO: 175153 - DNA, 400 bp, Homo sapiens
  Payload ID: 14393
  Gene Symbol: RETN
  Gene Name: resistin
  Uniprot ID: Q9HD89
  ENST ID: ENST00000629642
  CDS Start-End: 47-295
gtgtgccggatttggttagctgagcccaccgagaggcgcctgcaggatgaaagctctctgtctcctcctcctccctgtcctggggctgttggtgtctagcaagaccctgtgctccatggaagaagccatcaatgagaggatccaggaggtcgccggctccctaagcttcgccgtcaccggctgcacttgtggctccgcctgtggctcgtgggatgtgcgcgccgagaccacatgtcactgccagtgcgcgggcatggactggaccggagcgcgctgctgtcgtgtgcagccctgaggtcgcgcgcagcgcgtgcacagcgcgggcggaggcggctccaggtccggaggggttgcgggggagctggaaataaacctggagatgatgatgatgatgatgatg

SEQ ID NO: 175154 - DNA, 676 bp, Homo sapiens
  Payload ID: 14394
  Gene Symbol: RETNLB
  Gene Name: resistin like beta
  Uniprot ID: Q9BQ08
  ENST ID: ENST00000295755
  CDS Start-End: 200-535
aataaatctgttcttcagcaaccctacctgcttctccaaactgcctaaagagatccagtactgatgacgctgttcttccatctttactccctggaaactaaccacgttgtcttctttccttcaccaccacccaggagctcagagatctaagctgctttccatcttttctcccagccccaggacactgactctgtacaggatggggccgtcctcttgcctccttctcatcctaatcccccttctccagctgatcaacccggggagtactcagtgttccttagactccgttatggataagaagatcaaggatgttctcaacagtctagagtacagtccctctcctataagcaagaagctctcgtgtgctagtgtcaaaagccaaggcagaccgtcctcctgccctgctgggatggctgtcactggctgtgcttgtggctatggctgtggttcgtgggatgttcagctggaaaccacctgccactgccagtgcagtgtggtggactggaccactgcccgctgctgccacctgacctgacagggaggaggctgagaactcagttttgtgaccatgacagtaatgaaaccagggtcccaaccaagaaatctaactcaaacgtcccacttcatttgttccattcctgattcttgggtaataaagacaaactttgtacctctc

SEQ ID NO: 175155 - DNA, 5754 bp, Homo sapiens
  Payload ID: 14395
  Gene Symbol: RCOR1
  Gene Name: REST corepressor 1
  ENST ID: ENST00000262241
  CDS Start-End: 227-1684
gtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccgccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagca

SEQ ID NO: 175156 - DNA, 411 bp, Homo sapiens
  Payload ID: 14395
  Gene Symbol: RCOR1
  Gene Name: REST corepressor 1
  ENST ID: ENST00000560472
  CDS Start-End: 1-108
cagacaaacagtgctctcaaagaaaaacttgatggtggaatagaaccatatcgacttccagagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagcca

SEQ ID NO: 175157 - DNA, 2604 bp, Homo sapiens
  Payload ID: 14396
  Gene Symbol: RCOR2
  Gene Name: REST corepressor 2
  Uniprot ID: Q8IZ40
  ENST ID: ENST00000301459
  CDS Start-End: 389-1960
gcgcccagccgctgaacggcgtgggcaggtgggcggtggggttccagggcgccccgaggacagggggccccgacttcaggggaaccccaaccctgaggggcgtacatagtaatcacgccccagccgcaccggaccttgcgctcatcccttgcgtcccccacttctgcacaaacttttctgacgccctggctcgtgggggtcgtggagagcgctggggctaccaggtgggctcccaccccgccggaccctagccacgctgacctcctgcctctcctaacctcagtggcgacctctccaggccgggccgggctcggcactcggagcgagtgcggcaaccactgtcgctctccgaaggctcctgcgccccccggggcagctgggcggggtaatgccctcagtgatggagaagccgagcgcgggctctgggatcctgtcccgtagccgggccaagacggtgcccaacggcggacagccccactcggaggatgacagcagcgaggaggagcactcgcacgacagcatgatccgcgttggaaccaattaccaggccgtaattccggagtgcaagcctgagagccccgcacgctacagcaacaaggagctgaaggggatgctggtgtggtcacccaaccactgtgtgtcagatgccaagcttgacaagtacattgcgatggccaaggagaagcatggctacaacattgagcaggcgctgggcatgcttctgtggcataagcacgatgtggagaagtcgctggccgacctggccaacttcaccccattccctgacgagtggacagtagaggacaaggtgctgtttgaacaggcctttggcttccatggcaaatgcttccagcggatccagcagatgctgcctgacaagttgattcccagcctggtgaaatactactactcttggaagaagacccgcagccgaactagtgtgatggacagacaggcccggcggctggggggccgcaaggacaaagaagacagtgatgagctcgaagagggtcgaggaggcgtgagtgagggagagcccgatcctgcagatcccaagagagagcctctaccctctcggcccctgaatgcacgcccaggccctgggaaaaaggaggtccaggtgtctcagtaccgccaccatcccttgcgaacccggcgtcgcccacccaagggcatgtacctgagccctgaaggcctcacggcagtgtcaggaagcccggaccttgccaacctcacgctccgaggtcttgactctcagctcatctccctcaagcgccaggtacagagcatgaagcagacgaacagcagcctgcgccaagccctggagggcggtattgatccactacgccccccggaggccaacaccaagttcaactcccgctggaccacagatgagcagcttttggctgttcaagccatccgtaggtatggcaaagactttggggctattgcagaggtgattgggaacaagactctgacccaggtgaagactttctttgtgagctaccggcgccgcttcaatctggaggaggtgctgcaggaatgggaggctgagcaggatggggcccctggagccccagtccccatggaggaggctaggagaggggctccattgccagccccagccctagaggaagatgatgaggtccagattacatcggtctccacgtccgtgccccgatcagtgccccctgcgccaccaccccctccacctcccacctcgctgtcccagccacccccgctgctgaggccacctttgcccacggctcccactctgctccgacagccacccccactgcagcagggccgcttcctccagccccggctggcccccaaccagcccccaccgcctctcatccgccccgctctggctgccccccgccacagcgcccgccctggccctcagcccccacccaccctgattggaacccctctggagcccccagcaccctcactctgagccctgacgtcctccaccaaccacgggctccaggacccctttgctggccatccccaggcatctctggtgtcactgaggacagaagggactagggctctggcggggtctttgtaagaccagagtttcggacagcccagccccgccctttgggttctgcatgtgttcctggcagctgggcctgtctcctggggccatggccgggctcaggggcctttgagctggcctgagggcactttcgcttcctggccggtactggaatggctgtgtcctagtctgctggggcttggcctctgggtcctgccctttgtgtgtccggggtagtgaccttagcgtggagtggggagagggcagttgggtgtgctggctgttctcattcctctttcccttcttttagcaataagtctggggtgaggtggggagggaggctgcagggggggaggtgggcagaggggccttacagcagcagaggctggaagagaagctctgtcttcaggggccagctgggaaatgctaaggagctgagggtgcccaccaagcccaccttccagaaacttggagaaatgggggttgggaacttatgcagacatggatttatttttcaacattttttaaaaattaaaaaaaataaaatctaagcttactga

SEQ ID NO: 175158 - DNA, 4246 bp, Homo sapiens
  Payload ID: 14397
  Gene Symbol: RCOR3
  Gene Name: REST corepressor 3
  Uniprot ID: Q9P2K3
  ENST ID: ENST00000367005
  CDS Start-End: 142-1629
gagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgttgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaatggagttggttttttttgtttctaaatgctatctgcttttaactagtagttgcctacatctggggacttcagagaagaattatattttgttagttaagtagacacagtggttatggaagcatttctttacagtaccctttacatgtttggtttctgaacttaaaattgccctcatacttaataatatggtctgcatttaatatgaaaggtgttttattgataaatctattgtactatttggatacatttgtgtattccttgcagccaacctgtattcgtgggattggtgtagggttaaatcatcaacattatttcataaaataagaatttgttctgtgttatctaaagatgtatcagtatattgtcacagttgtgctgttaactaaaaatgctgagacccctttttatagaaaaacaaaaagacatcaagtcttcttaattcaacccataatcattaagtacttaacaaagaatattttacaagtgatagtatttcaacaatgtgtaattaatatttttgatacagtgatttcatattggaatcattatttgtgcaaagggacagacagatcacttagattgctatactagtggacataggctacatgtttgcacattcacattcttatcacgtgtagaatacttcacaaaatagtcaacatctaaggccctaatttatgttttgaaagatcatgtgttcccaaagtattccctattgttggctccacagccttaaagtgctatagatttaaattcattgattagttttaatttttaattttagactgtgtatttccataaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattgtcttacgtatgtgcatactatacctttacagcgtttattgtcttgtctcttgtcagtagaccttcagtacacagtatgtgggatatgtcagtcaagttggtcagcaccagcatctgtccagctgttcagtatattgtgattcattaaaaaatctcttctatcccagacatgggccaaggtgctgtatctgagggatgtgctgtaatttgatttacatgcattagagcacacagtagaaaaactttagcttcattagtaatatgacacatgtatatagtgagatgtctttattgtgtgctttgcatattttgtaaatattttgcacgtcattatttttcttttttgtttaagcagtgtttggcctggaagagtgatatgcttgctgcttaatcaaaggattaaagatttaaagatgtctatgtcttctatttttatataatttcatgttctatgaggaatttagtacctcttcactgtgaaattcgaaataatgatttttataaaagcaaaactagaaatcttttaatgacaattttcattaatttcagggttatcatttttgagaaatctacaccaaagtggttttttaaaattacataactaaaaataaaccacactgtggatacatcttataaaactaatggaaacaatgtttttctatatgatttaattctagtgtaatatggatgaggtaagagtaagttatgatcaaactttttatgttcttaataagcttgcaattgagtaaaatagaatataaaataaaggtgaaataatataaaa

SEQ ID NO: 175159 - DNA, 2525 bp, Homo sapiens
  Payload ID: 14397
  Gene Symbol: RCOR3
  Gene Name: REST corepressor 3
  Uniprot ID: Q9P2K3
  ENST ID: ENST00000367006
  CDS Start-End: 283-1593
agagcgcggtgcggccgaggggcgcccgggactgcgcggggcgggcggcggcggagggaggaggggagagaggcggggccggggcgggttgttgtgaggcgactgcgctactgccggagcggggcggttatggcggctccatattaacagcctcctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgttgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaa

SEQ ID NO: 175160 - DNA, 1827 bp, Homo sapiens
  Payload ID: 14397
  Gene Symbol: RCOR3
  Gene Name: REST corepressor 3
  Uniprot ID: Q9P2K3
  ENST ID: ENST00000452621
  CDS Start-End: 174-1523
actgccggagcggggcggttatggcggctccatattaacagcctcctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggtgtgtttgtgtatggaatttgagctaatatgagttgaggaatcaccattttgtgtggtattctgtaaggttaatttgtcaagaggactagctaaattgagcatgaaaggttgacaatacacttcttcagtggtgcatctctcgtgactcttaagtcataatgacatgctaagttctgattctagaagaatggagagtgtattgttctttcatagtcttatttttattttcagtgttaagctgtttacaaataaagatgcctgtttggtagcctcattggtttttggtttttggttttgttttgtttaaaataaaagaagcttgtgcttccaataaa

SEQ ID NO: 175161 - DNA, 2041 bp, Homo sapiens
  Payload ID: 14397
  Gene Symbol: RCOR3
  Gene Name: REST corepressor 3
  Uniprot ID: Q9P2K3
  ENST ID: ENST00000419091
  CDS Start-End: 129-1790
ctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgttgatctcataaaa

SEQ ID NO: 175162 - DNA, 1497 bp, Homo sapiens
  Payload ID: 14397
  Gene Symbol: RCOR3
  Gene Name: REST corepressor 3
  ENST ID: ENST00000528926
  CDS Start-End: 166-1290
agcggggcggttatggcggctccatattaacagcctcctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccagtagagacaaggtcttgctatgtttcccaggctggtctcaaactccggggctcaagccatccgccctccttggcctcccaaagtgctgggattataggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcagtttcaggcatccactgggagttttggactgtatcccctgcggatatgggaggactactatattctgcttacaaaatgttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgt

SEQ ID NO: 175163 - DNA, 427 bp, Homo sapiens
  Payload ID: 14397
  Gene Symbol: RCOR3
  Gene Name: REST corepressor 3
  ENST ID: ENST00000534460
  CDS Start-End: 1-427
tgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgaggcacagaccccacaggctcctcggacactgggtccatcacctcctgcccca

SEQ ID NO: 175164 - DNA, 434 bp, Homo sapiens
  Payload ID: 14397
  Gene Symbol: RCOR3
  Gene Name: REST corepressor 3
  ENST ID: ENST00000485186
  CDS Start-End: 1-224
gtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgactggctactagggaaataaatgaatgtggaattgaggatggaacaaagaattcaatgctttacaataaatggactgtatttgagagttcaagagaggattggagaaaataactgagtatgtaaaaaatggtgtccgcaaatatggtaaagattttcaagctattgcagatgtaattggcaacaagactgttggccaagtgaagaacttctttgtaaactacaggcgtcg

SEQ ID NO: 175165 - DNA, 1022 bp, Homo sapiens
  Payload ID: 14397
  Gene Symbol: RCOR3
  Gene Name: REST corepressor 3
  ENST ID: ENST00000529572
  CDS Start-End: 170-304
aatccgctgccatctcccggagtgccccgagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtgctacaaagtacacagataaagacaatggagggatgcttgtatggtctccatatcacagtatcccagatgccaaatgcccatgaagaatgaaaaaacctaggatctgatggcattgctgcttaaatcctcaagcaggggagggagttactatgtagacatctgcccaggcttttcctcagtatatggagcggtaaagacatgccttcaaacttcaaagagcccactatcattaccattttaaagaggaaaggggaaagaactgacttcagcagccatcaggtcatctttgtgctctccatttctggacggagaccttctggatcattgaccatgcacttcttgaatcatggtgtggctttagacttcaatgtgatgtagcggacctgatcctttgcggcacatcagatataggaaacgtgcagtggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaa

SEQ ID NO: 175166 - DNA, 564 bp, Homo sapiens
  Payload ID: 14397
  Gene Symbol: RCOR3
  Gene Name: REST corepressor 3
  ENST ID: ENST00000534478
  CDS Start-End: 306-564
gcattacagagcacaactccttccaggctggaaacgctgccagaaagcagctctcgcttcacctctgccgggggactccgccctctcccccagcgctccaagcggagaccgcaggtcagcaagaactgaaaacgcgtctactgggccagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccgg

SEQ ID NO: 175167 - DNA, 540 bp, Homo sapiens
  Payload ID: 14397
  Gene Symbol: RCOR3
  Gene Name: REST corepressor 3
  ENST ID: ENST00000533469
  CDS Start-End: 92-540
aaacgctgccagaaagcagctctcgcttcacctctgccgggggactccgccctctcccccagcgctccaagcggagaccgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatag

SEQ ID NO: 175168 - DNA, 720 bp, Homo sapiens
  Payload ID: 14397
  Gene Symbol: RCOR3
  Gene Name: REST corepressor 3
  ENST ID: ENST00000529763
  CDS Start-End: 1-720
ggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgtaaactacaggcgtcggtttaacttagaggaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccc

SEQ ID NO: 175169 - DNA, 1496 bp, Homo sapiens
  Payload ID: 14398
  Gene Symbol: RFPL1
  Gene Name: ret finger protein-like 1
  Uniprot ID: O75677
  ENST ID: ENST00000354373
  CDS Start-End: 210-1163
gccgtgtcactggctcaggctcagttgctgggtcaccagtagaatggacccttcctccacctcagttcagagcacagtgatgattcgtgactttctttcccaatagaacttcaaatctctgaagacggggggtggggggatgtgcttgagtgtttgtactcatggtcttgttctagaagtgacaaagctgggacacaatacctttatgcatgaaaaggttgtcacttgtcacaactaacaggctttcacctcacggaaattttcttcccttgtgcacttttcccctggcagtggacatggctgcactcttccaagaagcaagcagctgtcccgtctgctcagactatctagagaaaccaatgtccctggagtgtggatgcgctgtctgcttcaagtgcatcaattcactgcagaaggagccccatggggaggatctactttgctgttgctgttccatggtctctcagaagaacaaaatcaggcccagttggcagctagagaggctggcttcccacatcaaggaactggagcccaagctgaagaagattctgcagatgaacccaaggatgcggaagttccaagtggatatgaccttggatgccgacacagccaacaacttcctcctcatttctgacgacctcaggagcgtccgaagtgggtgcatcacacagaatcggcaagaccttgccgagagatttgacgtgtccatttgcatcctgggctcccctcgctttacctgtggccgccactactgggaggtggacgtgggaacaagcacagaatgggacctgggagtctgcagagaatctgttcaccgcaaagggaggatccatctgaccacagagcgtggattctggactgtgagtttgagggatggaagccgcctctctgccagcacggtgccgctgactttcctcttcgtagaccgcaagttacagcgagtggggatttttctggatatgggcatgcagaacgtttccttttttgatgctgaaggtggttcccatgtctatacattcaggagtgtctctgctgaggagccactgcacttgttttttgctcctccaagtccacctaatggtgataagagtgtcttgagtatctgtcctgtgataaacccgggcactactgatgctccagtccatcctggggaggccaaataagcccccactgcaaaaaaacaaaaaacaggttaagaaaattacttgggtgggcagacttaggaacgctctactcggtaaaagcgttatacaaagtcataggagaaaaatatgggacaattcatgattatacttaatctaatttgattagtttataaattgagtcctaagtattaattattgccaccatccaactcattgagtcttatggttcacatcttgtttcctatagaaatattctgtattctgggatcaatttccaaatgcttttttatttctgtaagttcaaattaatgtattatagaagttatgagttaaataaacattggaatatca

SEQ ID NO: 175170 - DNA, 1496 bp, Homo sapiens
  Payload ID: 14399
  Gene Symbol: RFPL2
  Gene Name: ret finger protein-like 2
  Uniprot ID: O75678
  ENST ID: ENST00000248980
  CDS Start-End: 206-1159
gccatgtcactggctcaggctcagctgctgggtcaccaggagaatggacgcttcctccacctcagctcagagcacagtgatgattcgtgactttcccaatagaacttcaaatctctgaagacggggggtggggggatgtgcttgagtgtttgtactcatggtcttattctcggagtgacaaagctggaacacaatacctctatgcatgaaaaggttgtcacttgtcacaactaacaggctttcacctcatggaaatttttttaccttgtgtacttttcccctggcagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctactttgctgttgctcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccaccacggtgccgctgactttcctcttcgtagaccgcaagttacagcgagtggggatttttctggatatgggcatgcagaacgtttccttttttgatgctgaaagtggttcccatgtctatacattcaggagcgtatctgctgaggagccattgcgcccatttttggctccttcagttccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattgtacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatcacct

SEQ ID NO: 175171 - DNA, 1474 bp, Homo sapiens
  Payload ID: 14399
  Gene Symbol: RFPL2
  Gene Name: ret finger protein-like 2
  Uniprot ID: O75678
  ENST ID: ENST00000248983
  CDS Start-End: 1-1137
atggaggtggctgaattaggcttcccagagactgcagtgtcccaatccaggatctgtctatgtgctgtattgtgtggccactgggactttgcagacatgatggtgataaggagcctgagcctcatcaggttagagggtgtggaagggcgtgacccagtgggaggtgggaatctcaccaataaaaggccctcgtgtgccccttccccacaagacctgagcgcccagtggaagcagctggaggacagaggagcttccagcagaagagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctactttgctgttgctcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccaccacggtgccgctgactttcctcttcgtagaccgcaagttacagcgagtggggatttttctggatatgggcatgcagaacgtttccttttttgatgctgaaagtggttcccatgtctatacattcaggagcgtatctgctgaggagccattgcgcccatttttggctccttcagttccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattgtacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatcacct

SEQ ID NO: 175172 - DNA, 2407 bp, Homo sapiens
  Payload ID: 14399
  Gene Symbol: RFPL2
  Gene Name: ret finger protein-like 2
  Uniprot ID: O75678
  ENST ID: ENST00000400237
  CDS Start-End: 937-2073
tatcgctacactgccgcggcgagtaccgggttggcggcgctatcctgggctacaccgccggtggcgggaggcgttttaggggcgctatctggtgctgcactgcccgcgcaggagttgggttgggtgacctactccaggcgtcactgcccgaggctgggggctgatttggggcgctatcccgggagtcatttcctgtggcgaggggctggttgagggtggtatccgtggctgcactgcccacagcacagagcgggtttggggagttatcccgggctgcgctgcccgtggcagggggcaggctgccagcgccattgggtgctgcatgtactaggcacggatgagttaggggcgccatctgggactgcactgccggtggcgggcggtggaggtgtcagtgacagcggtggtctgcaagagaggagcggtcctcctcttcccggccacctcctcctgttcttgctcaagtgcggcgggcgcacagcatttcctgagcgcggcaggggccccagccccgtggtgcttcctggacccgcctcctattgctctgtgttgcagagaccgcctgggaccccggggcacgcagtagtggacacgaggaggctacagggccctgtgggtggaggaggcatcaggaacgggaaccggcacttgggtggggagggctggctggggttgagtttctgctgctcctgcttcccgaggagtgcagccagggtggctgcagctgttcctgtggagtgggaagcccgggcactgtggtgtctgcagtccccactccaggccgcagttcctggccagcttgcgctaaaaggagaggctggactttgaagtgtgggtgcttttctggctttgtctgcccggatgcccagtgccctgagaaggagctacatgccacgggctggaggctagagcctgtggcaccatgatttgcctccgatggaggtggctgaattaggcttcccagagactgcagtgtcccaatccaggatctgtctatgtgctgtattgtgtggccactgggactttgcagacatgatggtgataaggagcctgagcctcatcaggttagagggtgtggaagggcgtgacccagtgggaggtgggaatctcaccaataaaaggccctcgtgtgccccttccccacaagacctgagcgcccagtggaagcagctggaggacagaggagcttccagcagaagagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctactttgctgttgctcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccaccacggtgccgctgactttcctcttcgtagaccgcaagttacagcgagtggggatttttctggatatgggcatgcagaacgtttccttttttgatgctgaaagtggttcccatgtctatacattcaggagcgtatctgctgaggagccattgcgcccatttttggctccttcagttccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattgtacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatca

SEQ ID NO: 175173 - DNA, 1445 bp, Homo sapiens
  Payload ID: 14399
  Gene Symbol: RFPL2
  Gene Name: ret finger protein-like 2
  ENST ID: ENST00000626996
  CDS Start-End: 121-351
ccactctgcatcctgttctaggcttttctggctttgtctgcccggatgcccagtgccctgagaaggagctacatgccacgggctggaggctagagcctgtggcaccatgatttgcctccgatggaggtggctgaattaggcttcccagagactgcagtgtcccaatccaggatctgtctatgtgctgtattgtgtggccactgggactttgcagacatgatggtgataaggagcctgagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctactttgctgttgctcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccaccacggtgccgctgactttcctcttcgtagaccgcaagttacagcgagtggggatttttctggatatgggcatgcagaacgtttccttttttgatgctgaaagtggttcccatgtctatacattcaggagcgtatctgctgaggagccattgcgcccatttttggctccttcagttccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattgtacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatca

SEQ ID NO: 175174 - DNA, 1171 bp, Homo sapiens
  Payload ID: 14399
  Gene Symbol: RFPL2
  Gene Name: ret finger protein-like 2
  ENST ID: ENST00000628378
  CDS Start-End: 61-345
agaaggagctacatgccacgggctggaggctagagcctgtggcaccatgatttgcctccgatggaggtggctgaattaggcttcccagagactgcagtgtcccaatccaggatctgtctatgtgctgtattgtgtggccactgggactttgcagacatgatggtgataaggagcctgagacctgagcgcccagtggaagcagctggaggacagaggagcttccagcagaagagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctactttgctgttgctcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccaccacggtgccgctgactttcctcttcgtagaccgcaagttacagcgagtggggatttttctggatatgggcatgcagaacgtttccttttttgatgctgaaagtggttcccatgtctatacattcaggagcgtatctgctgaggagccattgcgcccatttttggctccttcagttccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgc

SEQ ID NO: 175175 - DNA, 1488 bp, Homo sapiens
  Payload ID: 14400
  Gene Symbol: RFPL3
  Gene Name: ret finger protein-like 3
  Uniprot ID: O75679
  ENST ID: ENST00000249007
  CDS Start-End: 206-1159
gccacgtcactggctcaggctcagctgctgggtcaccaggagaatggacccttcctccacctcagctcagagcacagtgatgattcgtgactttcccaatagaacttcaaatctctgaggacggggggtggggggatgtgcttgagtgtttgtactcatggtcttgttctcggagtgacaaagctggaacacaatacctctatgcatgaaaaggttgtcacttgtcacaactaacaggctttcacctcaaggaaattttcttcccttgtgtacttttcccctggcagtggacatggctgcactcttccaagaagcaagcagctgtcccgtctgctcagactatctggaaaaaccaatgtccctggagtgtggatgcaccgtctgcctcaagtgcatcaattcgctgcagaaggagccccatggggaggatctgctttgctgttgctgttccatggtctctcagaggaacaaaatcaggcccaatcggcagctagagaggctggtttcccacatcaaggaactggagcccaagctgaagaagattctacagatgaacccaaggatgcggaagttccaagtggatatgaccttggatgccgacacagccaacaacttcctcctcatttctgacgacctcaggagcgtccgaagtgggctcatcacacagaatcggcaagaccttgccgagagatttgacgtgtccgtttgcatcctgggctcccctcgctttacctgtggccgccactactgggaggtggacgtgggaacaagcacagaatgggacctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcaaggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttctgtattctcggatcaatttccaaatgctttactttttcatttctgtaagttcaaatcaatgtttaaattatagaagttatgaggtaaataaacatttggatatca

SEQ ID NO: 175176 - DNA, 1214 bp, Homo sapiens
  Payload ID: 14400
  Gene Symbol: RFPL3
  Gene Name: ret finger protein-like 3
  Uniprot ID: O75679
  ENST ID: ENST00000397468
  CDS Start-End: 19-885
cggcagcagcgagtggacatggctgcactcttccaagaagcaagcagctgtcccgtctgctcagactatctggaaaaaccaatgtccctggagtgtggatgcaccgtctgcctcaagtgcatcaattcgctgcagaaggagccccatggggaggatctgctttgctgttgctgttccatggtctctcagaggaacaaaatcaggcccaatcggcagctagagaggctggtttcccacatcaaggaactggagcccaagctgaagaagattctacagatgaacccaaggatgcggaagttccaagtggatatgaccttggatgccgacacagccaacaacttcctcctcatttctgacgacctcaggagcgtccgaagtgggctcatcacacagaatcggcaagaccttgccgagagatttgacgtgtccgtttgcatcctgggctcccctcgctttacctgtggccgccactactgggaggtggacgtgggaacaagcacagaatgggacctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcaaggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttctgtattctcggatcaatttccaaatgctttactttttcatttctgtaagttcaaatcaatgtttaaattatagaagttatgaggtaaataaacatttggatatca

SEQ ID NO: 175177 - DNA, 1035 bp, Homo sapiens
  Payload ID: 14401
  Gene Symbol: RFPL4A
  Gene Name: ret finger protein-like 4A
  Uniprot ID: A6NLU0
  ENST ID: ENST00000434937
  CDS Start-End: 172-1035
atgaaatcagaatctgattggattaaaaaggagggaaagggtgtggctaaggtgggtggagacaccctctggtataaaagcccctggcaggcagctctcactccagatctgagctgtccgcagaagcagctggaggccaggggagaaactccagaaggagagacatttgccatggctgagcacttcaaacagatcattagatgtcctgtctgtctaaaagatcttgaagaagccgtgcaactgaaatgtggatatgcctgctgcctccagtgcctcaattcactccagaaggagcccgatggggaaggtttactgtgccgtttctgctctgtggtctctcagaaggatgacatcaagcccaagtacaagctgagggcgctggtttccatcatcaaggaactagagcccaagctgaaatctgttctaacaatgaacccaaggatgaggaagtttcaagtggatatgacgttcgatgtggacacagccaacaactatctcatcatttctgaagacctgaggagtttccgaagtggggatttgagccagaataggaaggagcaagctgagaggttcgacactgccctgtgcgtcctgggcacccctcgcttcacttccggccgccattactgggaggtggacgtgggcaccagccaagtgtgggatgtgggcgtgtgcaaggaatctgtgaaccgacaggggaagattgtgctttcttcagaacacggcttcttgactgtgggttgcagagaaggaaaggtctttgctgccagcactgtgcctatgactcctctctgggtgagtccccagttgcacagagtggggattttcctggatgtaggtatgaggtccattgccttttacaatgttagtgatgggtgccatatctacacattcatcgagattcctgtttgcgagccctggcgtccattttttgctcataaacgtggaagtcaagatgatcagagcatcctgagtatctgttctgtgatcaatccatccgctgccagtgccccagtttcttctgagggaaagtaa

SEQ ID NO: 175178 - DNA, 908 bp, Homo sapiens
  Payload ID: 14402
  Gene Symbol: RFPL4AL1
  Gene Name: ret finger protein-like 4A-like 1
  Uniprot ID: F8VTS6
  ENST ID: ENST00000341750
  CDS Start-End: 45-908
agctggaggccaggggagaaactccagaaggagagacatttgccatggctgagcacttcaaacagatcattagatgtcctgtctgtctaaaagatcttgaagaagccgtgcaactgaaatgtggatatgcctgctgcctccagtgcctcaattcactccagaaggagcccgatggggaaggtttactgtgccgtttctgctctgtggtctctcagaaggatgacatcaagcccaagtacaagctgagggcgctggtttccatcatcaaggaactagagcccaagctgaaatctgttctaacaatgaacccaaggatgaggaagtttcaagtggatatgaccttcgatgtggacacagccaacaactatctcatcatttctgaagacctgaggagtttccgaagtggggatttgagccagaataggaaggagcaagctgagaggttcgacactgccctgtgcgtcctgggcacccctcgcttcacttccggccgccattactgggaggtggacgtgggcaccagccaagtgtgggatgtgggcgtgtgcaaggaatctgtcaaccgacaggggaagattgagctttcttcagaacacggcttcttgactgtgggttgcagagaaggaaaggtctttgctgccagcactgtgcctatgactcctctctgggtgagtccccagttgcacagagtggggattttcctggatgtaggtatgaggtccattgccttttacaatgttagtgatgggtgccatatcaacacattcatcgagattcctgtttgcgagccctggcgtccattttttgctcataaacgtggaagtcaagatgatcagagcatcctgagtatctgttctgtgatcaatccatccactgccagtgccccagtttcttctgagggaaagtaa

SEQ ID NO: 175179 - DNA, 1900 bp, Homo sapiens
  Payload ID: 14403
  Gene Symbol: RFPL4B
  Gene Name: ret finger protein-like 4B
  Uniprot ID: Q6ZWI9
  ENST ID: ENST00000441065
  CDS Start-End: 313-1104
gagaggagcagaggtctgtagaggtagagacgtaggcttcggatcttttagaattctgctggaagtctccaagtcaagaggatctacaaagaaatactgagtggagactatactgagattctgttaaagacccacttgaattcagcccccattaggagaaactttggccggagcagccaacacatcacctggaagtcttcagactagactattgaagagtggattgtgtactgagggctcccaagtgcttccagaagccaataaaggatcacttcagtttacttcacggctaaggagtaacccttaagaaccatggccaaacgcctgcaagcagagttgtcctgtccagtttgcctggattttttctcctgttccatttctctctcttgtacacacgtgttctgctttgattgcatccagaggtatatactagaaaaccatgattttagagcgatgtgccccttgtgtcgagacgtggtgaaggtacctgctttggaagaatggcaagtgagcgtcctaacacttatgaccaagcagcacaatagccgacttgagcaaagtctgcacgtgagggaggagctccggcattttcgggaggatgtgaccctggatgcagccactgccagctccctccttgtcttctccaatgatctaagaagcgctcagtgtaagaagatccaccacgatctgacaaaagatcccaggctggcctgtgtcctgggtactccctgcttctcctccggccaacattactgggaggttgaagtgggagaggtgaagtcatggtccctgggcgtctgcaaggagccggctgacagaaagagcaatgatttattccctgagcatggcttctggatcagcatgaaggcaggagcaatccatgctaacacccacctggagagaattcctgcaagccctcgccttcgccgtgtgggaattttcctggatgctgacttagaagaaatccagttttttgatgttgacaataatgtcctcatctatacacatgatggtttcttctctttggagcttttgtgtccattcttctgtcttgagctcttgggagaaggggagagtggcaacgtcctgaccatctgcccatgagaaagtcagcccttcctagaagctttctgagaggtgaaagagaattttggcctgagaaaggtcagcatgattgaggaagagataatgtgctatagtgcaaagacttggtaaatttttaaagtagattttgtagactttgtagcaaaacaattttcggatttttggggtaaattttgtggaatttgtagctaggtaactggggtctttagggatgttattaagtactgtaagcttcagttttctagtctgtagatgcggataattgtatctcagtcaaacagctgtggtaattagagacaatactatgcctttgtcttatagtaaataacaaatagagaaatcttagattgtaagtaagctagatattaggttttgtggatagacaatatctttttcattatttcaagctgttttgtgtaattcctgataatgtctgaggaggaagaaaaattcaacagccagtgtgagttattttgttgatacagcatgaaatttcagagagacaaactgatattggggaagaactaagtttttcatttttattttctttgaaacacagccacataagttttcttgaaagacaaagaactttgaccaaaatgcattgttaatggtgattcatattcttatgggaagtgtcatttacccatctcaataattggactattgtgatttataagaattcttatcaaccatgttaactaacacatattcatcaaaaattgttttcaaggttgcttttggattttttatttgtagaatttattttcttgcaaataaatttataaagcattgg

SEQ ID NO: 175180 - DNA, 4149 bp, Homo sapiens
  Payload ID: 14404
  Gene Symbol: RET
  Gene Name: ret proto-oncogene
  Uniprot ID: P07949
  ENST ID: ENST00000340058
  CDS Start-End: 181-3399
ccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagctgcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattt

SEQ ID NO: 175181 - DNA, 5659 bp, Homo sapiens
  Payload ID: 14404
  Gene Symbol: RET
  Gene Name: ret proto-oncogene
  Uniprot ID: P07949
  ENST ID: ENST00000355710
  CDS Start-End: 233-3577
ccctacccgctcctccggcgcagccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagctgcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaa

SEQ ID NO: 175182 - DNA, 729 bp, Homo sapiens
  Payload ID: 14404
  Gene Symbol: RET
  Gene Name: ret proto-oncogene
  ENST ID: ENST00000498820
  CDS Start-End: 186-729
cgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgccc

SEQ ID NO: 175183 - DNA, 4337 bp, Homo sapiens
  Payload ID: 14404
  Gene Symbol: RET
  Gene Name: ret proto-oncogene
  ENST ID: ENST00000615310
  CDS Start-End: 191-1567
agtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatc

SEQ ID NO: 175184 - DNA, 1328 bp, Homo sapiens
  Payload ID: 14405
  Gene Symbol: RTBDN
  Gene Name: retbindin
  Uniprot ID: Q9BSG5
  ENST ID: ENST00000322912
  CDS Start-End: 319-1104
gcgcggacccaacctggctgctgcagtacttgctctaactttgccgcagctgcctcccttctctcggaacccactctcctaacccacccccgagaggcggagagaatgtgggagcacttcagagaggcctaggctccggagatcgggccatctgggctctgaaagcaaattagttttccaactcatgtctggctccggcgttacccagacgcctggaaggtccttcctgcagtctgatcaccatttttcctgctgcactgaccaatcagctccccttggccttcaacctcgggaatgatggattaggggagtctagaaatggacgaagccctagaaacgcagctgaagacgagcagaggacgcttctcggctacagaatccctccccaccttggagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagca

SEQ ID NO: 175185 - DNA, 1000 bp, Homo sapiens
  Payload ID: 14405
  Gene Symbol: RTBDN
  Gene Name: retbindin
  Uniprot ID: Q9BSG5
  ENST ID: ENST00000393233
  CDS Start-End: 83-772
gccagtttcctggactggatcctgaggtgtcttagcggcctctagaccccaatccagccaacagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagcacgtg

SEQ ID NO: 175186 - DNA, 1066 bp, Homo sapiens
  Payload ID: 14405
  Gene Symbol: RTBDN
  Gene Name: retbindin
  Uniprot ID: Q9BSG5
  ENST ID: ENST00000458671
  CDS Start-End: 154-843
gcagggagcgagagagggaggagggaggccgcatagaagagagggaggaattactgaacaggagagggggattggaagacctagggaggtccccttcattctgagaaaagaaggggtctcttgaagactaaaaagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagc

SEQ ID NO: 175187 - DNA, 692 bp, Homo sapiens
  Payload ID: 14405
  Gene Symbol: RTBDN
  Gene Name: retbindin
  ENST ID: ENST00000586969
  CDS Start-End: 51-692
cctgaggtgtcttagcggcctctagaccccaatccagccaacaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctg

SEQ ID NO: 175188 - DNA, 641 bp, Homo sapiens
  Payload ID: 14405
  Gene Symbol: RTBDN
  Gene Name: retbindin
  ENST ID: ENST00000589808
  CDS Start-End: 83-641
gccagtttcctggactggatcctgaggtgtcttagcggcctctagaccccaatccagccaacagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatct

SEQ ID NO: 175189 - DNA, 637 bp, Homo sapiens
  Payload ID: 14405
  Gene Symbol: RTBDN
  Gene Name: retbindin
  ENST ID: ENST00000589681
  CDS Start-End: 58-637
actggatcctgaggtgtcttagcggcctctagaccccaatccagccaacaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccggg

SEQ ID NO: 175190 - DNA, 1024 bp, Homo sapiens
  Payload ID: 14405
  Gene Symbol: RTBDN
  Gene Name: retbindin
  Uniprot ID: Q9BSG5
  ENST ID: ENST00000592204
  CDS Start-End: 77-796
gtagtggaggaggtggaatgaagagtgagaaagctgtctaggtgcctgtccaattagggcagtaggaagaatcctgatggccaggcagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagcacgtg

SEQ ID NO: 175191 - DNA, 465 bp, Homo sapiens
  Payload ID: 14405
  Gene Symbol: RTBDN
  Gene Name: retbindin
  ENST ID: ENST00000589567
  CDS Start-End: 75-465
gggattggaagacctagggaggtccccttcattctgagaaaagaaggggtctcttgaagactaaaaaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatca

SEQ ID NO: 175192 - DNA, 592 bp, Homo sapiens
  Payload ID: 14405
  Gene Symbol: RTBDN
  Gene Name: retbindin
  ENST ID: ENST00000585384
  CDS Start-End: 71-592
gactggatcctgaggtgtcttagcggcctctagaccccaatccagccaacagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggggatccccaggcctcagttcccaaaccttacctgaatatccaagaccctagctcacagggttcccctttgccaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgc

SEQ ID NO: 175193 - DNA, 620 bp, Homo sapiens
  Payload ID: 14405
  Gene Symbol: RTBDN
  Gene Name: retbindin
  ENST ID: ENST00000590404
  CDS Start-End: 49-620
gaaagctgtctaggtgcctgtccaattagggcagtaggaagaatcctgatggccaggcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctc

SEQ ID NO: 175194 - DNA, 861 bp, Homo sapiens
  Payload ID: 14405
  Gene Symbol: RTBDN
  Gene Name: retbindin
  ENST ID: ENST00000591512
  CDS Start-End: 650-861
cgcggacccaacctggctgctgcagtacttgctctaactttgccgcagctgcctcccttctctcggaacccactctcctaacccacccccgagaggcggagagaatgtgggagcacttcagagaggcctaggctccggagatcgggccatctgggctctgaaagcaaattagttttccaactcatgtctggctccggcgttacccagacgcctggaaggtccttcctgcagtctgatcaccatttttcctgctgcactgaccaatcagctccccttggccttcaacctcgggaatgatggattaggggagtctagaaatggacgaagccctaggtgagggtttgaatcctcttttcccaagattcaggctggggatggagcctgagtctgggcccattctcggctttatctaaactccagattaccaagcctggggctgagccccaaggaggctcagaagggccagaccccaggcagggccttggggcacagatatcatcaccttcccctctgggatgtttgggaccggacctccgtattaaccctgaacttccgtactaacccctcagaaacgcagctgaagacgagcagaggacgcttctcggctacagaatccctccccaccttggagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcagagatggacacaacagagacatcgggccctggaaaccatccaga

SEQ ID NO: 175195 - DNA, 2076 bp, Homo sapiens
  Payload ID: 14405
  Gene Symbol: RTBDN
  Gene Name: retbindin
  ENST ID: ENST00000589272
  CDS Start-End: 331-948
agaaacccgacggcgcggacccaacctggctgctgcagtacttgctctaactttgccgcagctgcctcccttctctcggaacccactctcctaacccacccccgagaggcggagagaatgtgggagcacttcagagaggcctaggctccggagatcgggccatctgggctctgaaagcaaattagttttccaactcatgtctggctccggcgttacccagacgcctggaaggtccttcctgcagtctgatcaccatttttcctgctgcactgaccaatcagctccccttggccttcaacctcgggaatgatggattaggggagtctagaaatggacgaagccctagaaacgcagctgaagacgagcagaggacgcttctcggctacagaatccctccccaccttggagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacaggctggagtgcagtggcgcgatctcagctcgatgcaacctccgcctccggggttcaagtgattctcctgccgcaacctcccgaatagctgggatttcaggcgcatgccaccatgcccagctaatttttgtatttttagtagagtcagcgtttcaccatgttggccaggctggtttcgaactcctgacctcaggtgatccgcccacctcggcctcccaaagtgttgggattacaggtgtgagccaccgcccccggcccccaccaagttctttcttaccgtgtctagaccccagagaccggattggtactccccaggtccctgctcccacccttccctagcccaacctcctactgggttgtgccctttgaccccaaaagctctcgaagtccagatttgcccttcccaagaaaccattcctgctctgggtccatccacattttaccctggaggacccagaagcccagtcactctctacaaaaccccagccttgatacagacctctctgcgcgccccccaactgccccaaccctgattcatcccgctagggcccagtaagaacattcaccctccccaaggacctgcccccactcacgttccgcacatagactcccaggccgcacgctccggctctgaccccaatccctaaggaatttacacatttttcccttcccgaggccacgccccccacgtctctggactccgcccactagggccttaactccactttttcctagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagcacgt

SEQ ID NO: 175196 - DNA, 658 bp, Homo sapiens
  Payload ID: 14405
  Gene Symbol: RTBDN
  Gene Name: retbindin
  ENST ID: ENST00000587549
  CDS Start-End: 318-658
cgcggacccaacctggctgctgcagtacttgctctaactttgccgcagctgcctcccttctctcggaacccactctcctaacccacccccgagaggcggagagaatgtgggagcacttcagagaggcctaggctccggagatcgggccatctgggctctgaaagcaaattagttttccaactcatgtctggctccggcgttacccagacgcctggaaggtccttcctgcagtctgatcaccatttttcctgctgcactgaccaatcagctccccttggccttcaacctcgggaatgatggattaggggagtctagaaatggacgaagccctagaaacgcagctgaagacgagcagaggacgcttctcggctacagaatccctccccaccttggagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggggatccccaggcctcagttcccaaaccttacctgaatatccaagaccctagctcacagggttcccctttgccagg

SEQ ID NO: 175197 - DNA, 695 bp, Homo sapiens
  Payload ID: 14406
  Gene Symbol: RER1
  Gene Name: retention in endoplasmic reticulum sorting receptor 1
  ENST ID: ENST00000306256
  CDS Start-End: 165-695
gtgctcgctgcagcttcccggagccggagcgcagcgcctgcggccgcccgtgccccgccgtcctccttcccgcggccgtgagggagaccgcggctcggccgtagcggagctgcgagggaagcctgtgtacctgctactttttcccgaacaattcatgttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttc

SEQ ID NO: 175198 - DNA, 1404 bp, Homo sapiens
  Payload ID: 14406
  Gene Symbol: RER1
  Gene Name: retention in endoplasmic reticulum sorting receptor 1
  ENST ID: ENST00000378512
  CDS Start-End: 77-640
ccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttgggatgcttctgtttgcggggacggtcggtgcagctgcaaggctggaggcggccggcaggtgcccggtgctggctgcagatgcggcgctaaccttctctccccacttgaaggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaa

SEQ ID NO: 175199 - DNA, 3000 bp, Homo sapiens
  Payload ID: 14406
  Gene Symbol: RER1
  Gene Name: retention in endoplasmic reticulum sorting receptor 1
  ENST ID: ENST00000378513
  CDS Start-End: 192-545
agcccttggccccgccctcgcgccatcttgggggccctggaggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttgagattattttgacacatttctttgatacgtagagtgttttgtttttaatttaaatctgtcctcatgcaaccctccatgaggggcagcgaagctggcagggagcagactggctttgtaggttcagcactcggccccccactgcgggagaggcggaacccacttgcatgtcagcgtttttgattcgagaaaagaaatactctcaacgttttaccaagtgattttacctccacctttactaaagtctttacctaaaacatggcagtcgctggacacaggaaagcccaccttttgtttggccttttcgaaaggtgacccatattgcacagcagaacatcacagctgtggtcccagatgagacactgacatgcgagtgaaggcctctcctcctgggccccgggctgcgcaggctcctcactctgggcggtgtttcctgtctcagaattgacacggtgaatgcttagtgtctggattttcttgtaccagtgtttacatatctgacatcgagctcctctaagaggccacgttcaagcttgtgtgtccctgacccaagatagccagtgctgctcccaggtggtacttctggtaccgtgttgagacacttgggattctcagactgtggacaggagtgtttgtcatttttcatactgttttcttaataagcgctcaggcctaaggtgtgacaggaagtcgcacgcgcttggccagagcacagtgaagcaaaggactgggtgctgatggatggagccacggcggcatctgcccacccggccgcagcccccagtgcctctcctggtggtcctcccagtctagagggtcacggcccccccgccctcctccgtctctggcaagctgaccttgactaacccaggaatacagggtcatcctcattcctaagtaagtcaaacagcaagacatggtttgcgcgggtctttgccggaagccggtcctgctggccaggtgttttacgtcagcagggaaatgtggcacacgccctcgaggcattttaacactgcgcttcaggaaatctcaagttccatcttgtgttagtaacgtacccacattttgctggagttagtttattaaagatgcctacggtgaactctctggcgcaggttaaatgcagttttgaaaacctggaaacatcaaatggaggcgggaaataggctggggccgagctgaggggctgaacacagcagtgaccgtgggtcagcaggtcgcctgcccagcaggccccccaggagagggctcgggcgcccctggcagcccccatacccccaggacctggctcgtgagtgcgtctgggtcaggaagagacctctctgtgcgtctcaggctgagatgcagatttctgttttctaaaactggaagcgaccttgacgtgtattgaaggtgtgtgtgccaaatgcttccgacggaggtgctggccttggttggtttctctctgccccgtgtggtcatcaagtcctgggggatgtgctctgcccagccgccctcggggagagcagcgccgcctcccatggggccgtggggctgctgttctcactgcactggctgaagcaacccgccagcctccgtgccccaccccacccagcacgcactcattcagtccattgccttaacacaagcctgatggggctgttttctcacaatataaacgaataaagtgtcttctggcctacttctg

SEQ ID NO: 175200 - DNA, 522 bp, Homo sapiens
  Payload ID: 14406
  Gene Symbol: RER1
  Gene Name: retention in endoplasmic reticulum sorting receptor 1
  ENST ID: ENST00000378518
  CDS Start-End: 139-492
gaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacga

SEQ ID NO: 175201 - DNA, 540 bp, Homo sapiens
  Payload ID: 14406
  Gene Symbol: RER1
  Gene Name: retention in endoplasmic reticulum sorting receptor 1
  ENST ID: ENST00000443438
  CDS Start-End: 66-540
gttttatctccctttctgttttgtttgtgaccaggcataaagcagtcaccttcaacagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttct

SEQ ID NO: 175202 - DNA, 2469 bp, Homo sapiens
  Payload ID: 14406
  Gene Symbol: RER1
  Gene Name: retention in endoplasmic reticulum sorting receptor 1
  Uniprot ID: O15258
  ENST ID: ENST00000488353
  CDS Start-End: 1787-2377
gctttaatgggaaacagtctgagtaaaacggggaaacttacaaggagctataggacgaacaatgtgacgggtggctttcagatggcctggctttggcctaaatagggtggccattccaggtgacacattttagtgtagcctctatttaaatatggagttctttcagtggagagtaaaggtgctcctcctctgtgtctggtttacacggctccgcgagaccaaagggcccctcggtctccttgagcagcctggcactctgcacagaggatccaggaacggtgtcatggagccacattctgcacagacttgatgatgtggagggagctgcctggatcacttcagcgcatcagttgtgatgggagagccaaggcacttgagggcgggattgcgtctggccacctgttgccttccacctgaagggaagatttccccagtgctcacagtgaggatgggactggaaaagcgttggtttcaggaaggtgcaggttctggctcctgcccactgcgaacatgctgatgggccagggcaactctttagtctttgtgagcttcagttttcttatctgtaaatgagaacaataagactgaccccaactgttgctgaggaatgatgtctttgctttcatgtctggtatttcttagagcctcattttacagatgaggaaactgaggctggctgcgtgctcagagggtttgctgaaggcctcacagccgcttagcacaggtgggactttaagccaaacttgagaccagagtctgtttctcctcactgccctgccgagggagcagatggggggtggtgggggaggtgaacgtcacccctggcgtcttctctagctcaggggccaggaggcctctcatctttaaagtaggaatgacaaccggcaggccctgggtactgagctgtgctttaccgaagagcggcaggtcctgacgccgtctcctctcaggagtggggtggcggcgtgctcagctgaggagccaggtggcagtcaggcttggcttggcctgcccagaagcagggctgtggcaggaccttggacacgtggcttccactgtttgagacttggtgaaatgggggtcatgatgcccttcacttgagcatctgggaattaagtgggtgaacaatgtgacctctggcacctgggttctcaggtgaattcctcatggcatcacagcagtgttgaaataggagcagatacgttacctccgcttgccagataagaaactgggacgcagatggatggactacctgagagttgtagataacattttcctgttcatggggtggaggacctggccctgagaggacaggatccctcctgctcctgccagaccagagacccaggacagggcgtggagcagacaaggtgcctgggcgggggaaccctgagggatccacagagggtgcggtccttggagggaggacatgcagtgccacgtgccatggaccagccagtggaccccatggccagcaaggctgctcctggggccagtggggtggacagtcccgcccacgcaggtgactgaggtgccagtgtgggaatgaaaatgcggcctgtgctcctgggcccatgcgtctcacgctgcccttcctctccagggaagcctgtgtacctgctactttttcccgaacaattcatggtaaaaacacaaatggtatatggacaaaatactgaatgtggaagaaacctacttgacagtgttggtgaaaatagggccaggatttcacacccgtgaatgctttttactgaaaagtattttgtgtttttctcccagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacg

SEQ ID NO: 175203 - DNA, 3044 bp, Homo sapiens
  Payload ID: 14406
  Gene Symbol: RER1
  Gene Name: retention in endoplasmic reticulum sorting receptor 1
  Uniprot ID: O15258
  ENST ID: ENST00000605895
  CDS Start-End: 134-724
cggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttgagattattttgacacatttctttgatacgtagagtgttttgtttttaatttaaatctgtcctcatgcaaccctccatgaggggcagcgaagctggcagggagcagactggctttgtaggttcagcactcggccccccactgcgggagaggcggaacccacttgcatgtcagcgtttttgattcgagaaaagaaatactctcaacgttttaccaagtgattttacctccacctttactaaagtctttacctaaaacatggcagtcgctggacacaggaaagcccaccttttgtttggccttttcgaaaggtgacccatattgcacagcagaacatcacagctgtggtcccagatgagacactgacatgcgagtgaaggcctctcctcctgggccccgggctgcgcaggctcctcactctgggcggtgtttcctgtctcagaattgacacggtgaatgcttagtgtctggattttcttgtaccagtgtttacatatctgacatcgagctcctctaagaggccacgttcaagcttgtgtgtccctgacccaagatagccagtgctgctcccaggtggtacttctggtaccgtgttgagacacttgggattctcagactgtggacaggagtgtttgtcatttttcatactgttttcttaataagcgctcaggcctaaggtgtgacaggaagtcgcacgcgcttggccagagcacagtgaagcaaaggactgggtgctgatggatggagccacggcggcatctgcccacccggccgcagcccccagtgcctctcctggtggtcctcccagtctagagggtcacggcccccccgccctcctccgtctctggcaagctgaccttgactaacccaggaatacagggtcatcctcattcctaagtaagtcaaacagcaagacatggtttgcgcgggtctttgccggaagccggtcctgctggccaggtgttttacgtcagcagggaaatgtggcacacgccctcgaggcattttaacactgcgcttcaggaaatctcaagttccatcttgtgttagtaacgtacccacattttgctggagttagtttattaaagatgcctacggtgaactctctggcgcaggttaaatgcagttttgaaaacctggaaacatcaaatggaggcgggaaataggctggggccgagctgaggggctgaacacagcagtgaccgtgggtcagcaggtcgcctgcccagcaggccccccaggagagggctcgggcgcccctggcagcccccatacccccaggacctggctcgtgagtgcgtctgggtcaggaagagacctctctgtgcgtctcaggctgagatgcagatttctgttttctaaaactggaagcgaccttgacgtgtattgaaggtgtgtgtgccaaatgcttccgacggaggtgctggccttggttggtttctctctgccccgtgtggtcatcaagtcctgggggatgtgctctgcccagccgccctcggggagagcagcgccgcctcccatggggccgtggggctgctgttctcactgcactggctgaagcaacccgccagcctccgtgccccaccccacccagcacgcactcattcagtccattgccttaacacaagcctgatggggctgttttctcacaatataaacgaataaagtgtcttctggcctacttctgaa

SEQ ID NO: 175204 - DNA, 1348 bp, Homo sapiens
  Payload ID: 14406
  Gene Symbol: RER1
  Gene Name: retention in endoplasmic reticulum sorting receptor 1
  ENST ID: ENST00000630837
  CDS Start-End: 134-778
cggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaagccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatatttt

SEQ ID NO: 175205 - DNA, 2572 bp, Homo sapiens
  Payload ID: 14407
  Gene Symbol: RCN1
  Gene Name: reticulocalbin 1, EF-hand calcium binding domain
  Uniprot ID: Q15293
  ENST ID: ENST00000054950
  CDS Start-End: 294-1289
agccccgcgcccaccaccccagctggcgacgtggctccgcggccccggcttcccccggcagctcagcgaccaatgggcgcgcgagcggggccgcccgcagcttcccagcccgaggcccaggcgcgcccctctgctccggctcggggcgggcactggcggagggactggccagtcccctcctccgcgccggccccaaccctgtcgctgccgccgcgctccgagtccccattcccgagctgccgctgttgtcgctcgctcagcgtctccctctcggccgccctctcctcgggacgatggcgcgcggtggccgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaaggattttctactgtgtcctgtggtgtttgacttcacagatgctatttgtgacattattcatatagcataaaacagtggggttggatcccatgaataacattataaaggttctggggttttttttcatccaattactagaatgttcagaatagactcatatttactaatttaataaatgtatgtacttaatgcctttacttttctaggtcattttaactataaaatc

SEQ ID NO: 175206 - DNA, 549 bp, Homo sapiens
  Payload ID: 14407
  Gene Symbol: RCN1
  Gene Name: reticulocalbin 1, EF-hand calcium binding domain
  ENST ID: ENST00000528630
  CDS Start-End: 1-87
gaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttgtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaagga

SEQ ID NO: 175207 - DNA, 494 bp, Homo sapiens
  Payload ID: 14407
  Gene Symbol: RCN1
  Gene Name: reticulocalbin 1, EF-hand calcium binding domain
  ENST ID: ENST00000532721
  CDS Start-End: 436-494
ttgctggagggccccgggaccccagcttggagatcgccgccgccgcgccccggccggggtggtttctcgcggggaggcgagaacgtggcagcggccgcgggagccaggacggcgagggcccgccccctcccccaggttgcatcagaagggaggggagagtgcacaaaagaagagtttgtccacagtggcctgaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagc

SEQ ID NO: 175208 - DNA, 1191 bp, Homo sapiens
  Payload ID: 14407
  Gene Symbol: RCN1
  Gene Name: reticulocalbin 1, EF-hand calcium binding domain
  Uniprot ID: Q15293
  ENST ID: ENST00000532942
  CDS Start-End: 156-998
agaggaggtcctcggctcgccctgggcgcggagcgaggactctggtcagaggtaattatgtcaccgcgttttctcgccgtgacagccgaataaacacgatctccaataaacatctctaatgagggaggaggcccgaggatggctgggtttgatttatgactggaggagaaggtccacttcccactgcgaagcaggcgacctgctcgccgcccagctccagggagaggaacccgcggaggagaggatcccggcccaggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttc

SEQ ID NO: 175209 - DNA, 737 bp, Homo sapiens
  Payload ID: 14407
  Gene Symbol: RCN1
  Gene Name: reticulocalbin 1, EF-hand calcium binding domain
  ENST ID: ENST00000527337
  CDS Start-End: 1-172
ggaaaccctggaggacatcgacaagaacggggatgggtttgtggatcaggatgagtatattgacaaggaaacttcaggctcagtcactgaactaagtcaaaagccgggatttatcttttggcttctaaactcagttctttctactccaccacatggccttcatcatgaataaattactgcatcattatccccaagaagctgcctaccagctgtttgacggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaac

SEQ ID NO: 175210 - DNA, 527 bp, Homo sapiens
  Payload ID: 14407
  Gene Symbol: RCN1
  Gene Name: reticulocalbin 1, EF-hand calcium binding domain
  ENST ID: ENST00000530348
  CDS Start-End: 352-527
atctgtgtgtggtgcgtgtgtctccgcaccacgactccctctcctgggtctgctcagtccacggaggcagctccccttcagctgttgccagaaaaccggggaggaaagaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatca

SEQ ID NO: 175211 - DNA, 1750 bp, Homo sapiens
  Payload ID: 14408
  Gene Symbol: RCN2
  Gene Name: reticulocalbin 2, EF-hand calcium binding domain
  Uniprot ID: Q14257
  ENST ID: ENST00000320963
  CDS Start-End: 105-1112
cgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaaggaatttgccatttgtaaaaaacagtctttctgtttttggcttcttcgatttaatcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaa

SEQ ID NO: 175212 - DNA, 1366 bp, Homo sapiens
  Payload ID: 14408
  Gene Symbol: RCN2
  Gene Name: reticulocalbin 2, EF-hand calcium binding domain
  ENST ID: ENST00000394883
  CDS Start-End: 88-738
gtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttga

SEQ ID NO: 175213 - DNA, 6347 bp, Homo sapiens
  Payload ID: 14408
  Gene Symbol: RCN2
  Gene Name: reticulocalbin 2, EF-hand calcium binding domain
  Uniprot ID: Q14257
  ENST ID: ENST00000394885
  CDS Start-End: 224-1177
atataggcctcctcctggcgcgcctccgcaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgtatatgtttgtttgcttttctttaactttcagataaatattgaatttagcataggttttgtggtattgtacattatcttgcctcatccattcctttatgtggatagttcccaaaactgtcaaattattcttgctgcattttcttattttttttttaaataagagaatcatgttataatataattgaatgtgcacctgacacattttaataattggtgttgtagcaaatgtggttttgctctttggggctataaataatcttgagtaacgcaggttggaattaccaatagagctggtcagttatcaacagtagagctcagtatcaattttactgaaattaaaatcatacttgataagcatgataatcaattttaacctaattcagcaggtcaacttatttaactttggtggaggtgggatagggaaaagtgaagggaggaattaatttttttctagttctgatgtacagagattgtttttcattcttttttttttttttttttttgtgacagagtcttgctctgtggcccaggctggagtgcaggggcactatctcggctcactgcaagctctgcctcctgggttcacgccattctcctgcctcagcctcccgagtagctgggactacaggcgcctgccaccacacccggctaatttttttgtatttttagtagagaccgggtttcaccgtgttagccaggatggtttcgatctcctgacctcatgatcagcccacctcggcctcccaaggtgctggaattacaggcgtgagccaacgcgcacggcctctagtttttcattctttaaatcacttttatttgtgggtgaagaggtcagctatgcattctcttaatcactttccagcctaaagttgtctcatatacagcacactgggggctcaacaagtacctatgactatttgagaagacatgaaactcttctctgatagaatcgactgcacctatatacctctctactgccgcatctttgctgatgtgaggtgtgcttgcaaattgtaagcttccacaccttaatgactgcttgcttgggtatctacatggttttcattttaacctacactatatgtctggctatagcagttttagaattacagatttaccactatcactcatctgtcatttgtcagactcactgaagctggcatatttgaaatcaccagtttgactagttaactatttgtttttctctctagcttctccaaaatctatgccagaatagatcatcagatatggattatatttcaatcctttgcagaaatgcaatgtctgtactactttccttcctagcataaagaaaactacacttcccagccctcttgtaggtaggcgatggctagttctgaccagttaaacatgggtggaagtagtgtgtgtcactatcagactatctcatgacaaacccttttcctctgccacagcactgtgcaggaggcctcagctgaaatggtgcagccacaagatgaaagtggctttgatcttgagtctgtgtaggtcagctggatccacagtgggctttgtatgatcaaaaaataagcttttaattatgttaagccactgagatttggttgtgcttttttgtttttaaccacagcagagcccatcctgctgtgactgagtgaagatttcacatttaacaataggcttttaataagcatgcagagaaaaagaatcatctgcttgaacagagatgctatatctactgctgagtcaaaatagaaaattttaaggctttttttagatttgaattttaaataagacttttaaaataaagcttttattttggttttaatataattaggataatttgaatttatccttgagcatgagagtaaaaatagtttgagactttctgaatcattggctgattctgcctgaaggacttaatgacttccattatttgagttcaggtacaacttcaaaggggaaaattgaatgggatgtgcacatgttggctcatatgtagttctgattgggccaatttgcaggacagaaaatgatgtctagattatgatataaatttaaaggaagccaggacgttcagaggaaaagctagcatatcatgtttgccttacttagttctttcctttgcagttttaaaaataggctttttttttttttagtgtagttttatgttcacagcaaaattgagcaaaaagtagtatagagagtttcaatatgtcccctgccccacatacgtacagcctcccccactatcctatcctatatgtcatgagatagtacctaccagagtggtacatttgttaaaatcgatgaaactgttaacatatcattgtcacccaaagtgcatagtttacattagggttcactcttggtgctgcacatgctctgggtttggacaaatgtataattacatattcccaccattgtagtgtggtagaatatttcccttgccctaaagtctttctgctccacctattcatccctcccttccctgtaaccccaagcaatactgatctttttactgttcataattttttagattgtagtaaaatacacataacaaaattcatcttaacagtttttaattgtacagttcggtggtatggtattaaatacagtcaaaatgtgaaactattaccaccttccatctccatgaacttcatttgtaaaacggaaatttatacccattaaacaataaagccccctttccccttcccttcagcacctggcaaacaccattctagtttttttgtttgagatggagtcttgctcttgttgcccaggctggagtgcaatggcatgatttcggctcactgcaacctctgtctcttggggtcaagcgattctcctgcctcagcctcccgactaggtgggattacaggcgggcaccaccatgccccctaattttttgtatttagtagaaatggggtttcaccatgttggtcaagctggtctcgaactcctgatctcaggtgatccacctgcctcagcctcccaaagtgctggaattacaggcgtgagccaccgtgcccagcctcccattctagttttctttttctttcttttttgagacggagtctcactcttgtcatccaggctggagtgcagtggtgcgatctcggctcactgcaacctccacctcccaggttcaagcgattctcctgcctcagcctcccaagtagctgggattatagatgcccgctaccacgcccggctaatttttgtacttttagtagagacggggtttcgccatgttggcatggctggtctcgaactcttgacctcaggtgatccacctgcctcggcctcccaaagtgctgagattacgggcatgagccaccgcgcccagccccattctagtttgtgtctattaaaatagactcatatagtatttgtctttttgtgagtggcttcacttagcataacgtccccaaagttcacccatattgttaccagaatttctttcgtcaggctgaacaatactttattgtttgcatataccacattttgcttatccattcaccctttgatggacacaggttgcttccaccttttattgtgaataatgctgccatgaatatgggtgtacaaatatttctttgagatcctgcttttagttcttttggatatatattatacatagaagtgggattgctggatcatatagtaattctatatatatatatatatatatatatatatatatatatattttttttttttttttttttttttttttttttgagacggagtctcgctctgtcgcccaggctggagtgcagtggcgcgatctcggctcactgcaggctccgcctcccgggttcacaccattctcctgcctcagcctcccgagtagctgggactataggcgcctgccaccgcacccggctaattttttgtatttttagtagagacggggtttcaccgtgttagccaggatggtcttgatctgctgacctcgtgatccgcccgccttggcctcccaaagtgctgggattacaggcgtgagccaccgcgcccgactagtaattctatttttaatattttgaggaactgccatagtgtttcccacagcagctgtgccattttgcatttccaccaatagtgcacaagagttccagtttctttacatccttaccaacacttgctattttctgtttttttttttttcttttttttttttaatagtagccatcctgttgggtgagacgtggtatctcgttgtggctttgatttgcatttccctaatggtctgtctctacagttttgcctgttccagaatatcattcctttgcaatttaaatgtgaggataaatgtatgctattgtttctcaaacgtttttgtgttacaatacctccttttgagtgagaaatgtcaactcaaacttacactttttcacttaggaagatgatttaggaaagccacttagagtaaaagtttttaaacaactgtaaaaactaatttgcttcattgcaacatttgagttctgtcgaataaatatttggccag

SEQ ID NO: 175214 - DNA, 691 bp, Homo sapiens
  Payload ID: 14408
  Gene Symbol: RCN2
  Gene Name: reticulocalbin 2, EF-hand calcium binding domain
  ENST ID: ENST00000557805
  CDS Start-End: 1-466
ggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcatcaatgtggaggtttggggctccatcctcagagccagtctgcttagcttcacatttagctccagcacttcacggttgtgtaactttggcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaa

SEQ ID NO: 175215 - DNA, 1859 bp, Homo sapiens
  Payload ID: 14409
  Gene Symbol: RCN3
  Gene Name: reticulocalbin 3, EF-hand calcium binding domain
  Uniprot ID: Q96D15
  ENST ID: ENST00000270645
  CDS Start-End: 448-1434
tttttgtttatttttgttttgttttgttttgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccgggaccttg

SEQ ID NO: 175216 - DNA, 549 bp, Homo sapiens
  Payload ID: 14409
  Gene Symbol: RCN3
  Gene Name: reticulocalbin 3, EF-hand calcium binding domain
  ENST ID: ENST00000597801
  CDS Start-End: 99-549
cctctaagcatcccgccctcttttcccccatcgcccgccctttttgagcccgaaagcttgcagccaacttccaactccctgtcctgtcctagggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgaagaatttcatgacgtggaggatgcagagacctacaaaaagatgctggctcgggacgagcggcgtttccgggtggccgaccaggatggggactcgat

SEQ ID NO: 175217 - DNA, 607 bp, Homo sapiens
  Payload ID: 14409
  Gene Symbol: RCN3
  Gene Name: reticulocalbin 3, EF-hand calcium binding domain
  ENST ID: ENST00000598833
  CDS Start-End: 1-510
ttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctcttttcttttccaggatttatctcctcaccttccttttgctgtagttcttcaagctaggaagactggatttccctctggtgttttagctgccagtcatggtatgaactagaactcacccccaagtaaaagctgtacaaataa

SEQ ID NO: 175218 - DNA, 595 bp, Homo sapiens
  Payload ID: 14409
  Gene Symbol: RCN3
  Gene Name: reticulocalbin 3, EF-hand calcium binding domain
  ENST ID: ENST00000593483
  CDS Start-End: 1-175
gacggagaggcagcagttccgggacttccgggatctgaacaaggatgggcacctggatgggagtgaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggga

SEQ ID NO: 175219 - DNA, 3435 bp, Homo sapiens
  Payload ID: 14410
  Gene Symbol: RTN1
  Gene Name: reticulon 1
  Uniprot ID: Q16799
  ENST ID: ENST00000267484
  CDS Start-End: 337-2667
aggaggacccggaccaagcaggccattttcacctgcgtaataacaggattgggaatagcgaagcagcggcggcagcagcgagtggagtaggaggaggagcgcaggcagcggccgcggcggggccggaggaagaggaggggggagaaggaggagctgaagcgggaagagcggcaggcagcggctcggcggagttgcagcagaggcggcggcgacgctgagacaccgcagcttccctgagcgccgagtccctccggggacagcagcagggagcgcccgcgcagccaccgagcctctgcccagccaagccgccgtcgccgcgccgggggaccgccagccatggccgcgccgggggatccgcaggacgagctgctgccgctggccggccccgggtcccagtggctcaggcaccggggggagggggagaacgaagcggtgacgccgaaaggggccacgccggcgccgcaggctggggagcccagcccggggttgggcgccagggcccgggaagcggcgtcgcgggaagccggctcgggccccgcccggcagtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgt

SEQ ID NO: 175220 - DNA, 1703 bp, Homo sapiens
  Payload ID: 14410
  Gene Symbol: RTN1
  Gene Name: reticulon 1
  Uniprot ID: Q16799
  ENST ID: ENST00000342503
  CDS Start-End: 309-935
agaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgt

SEQ ID NO: 175221 - DNA, 1609 bp, Homo sapiens
  Payload ID: 14410
  Gene Symbol: RTN1
  Gene Name: reticulon 1
  ENST ID: ENST00000395090
  CDS Start-End: 260-841
cgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggtttcttcaaggaaagtccatgaagtgcctgccattcacagacttcttgagcaggtggcctcctggttggagatttaggaggcttccctagagggcatgccatttctaccagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgt

SEQ ID NO: 175222 - DNA, 2647 bp, Homo sapiens
  Payload ID: 14410
  Gene Symbol: RTN1
  Gene Name: reticulon 1
  ENST ID: ENST00000611068
  CDS Start-End: 122-2230
ctgagacaccgcagcttccctgagcgccgagtccctccggggacagcagcagggagcgcccgcgcagccaccgagcctctgcccagccaagccgccgtcgccgcgccggtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttgg

SEQ ID NO: 175223 - DNA, 2293 bp, Homo sapiens
  Payload ID: 14411
  Gene Symbol: RTN2
  Gene Name: reticulon 2
  Uniprot ID: O75298
  ENST ID: ENST00000245923
  CDS Start-End: 237-1874
cccggccgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacccga

SEQ ID NO: 175224 - DNA, 2063 bp, Homo sapiens
  Payload ID: 14411
  Gene Symbol: RTN2
  Gene Name: reticulon 2
  Uniprot ID: O75298
  ENST ID: ENST00000344680
  CDS Start-End: 231-1649
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaa

SEQ ID NO: 175225 - DNA, 1127 bp, Homo sapiens
  Payload ID: 14411
  Gene Symbol: RTN2
  Gene Name: reticulon 2
  Uniprot ID: O75298
  ENST ID: ENST00000430715
  CDS Start-End: 96-713
gccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaa

SEQ ID NO: 175226 - DNA, 2357 bp, Homo sapiens
  Payload ID: 14411
  Gene Symbol: RTN2
  Gene Name: reticulon 2
  ENST ID: ENST00000590526
  CDS Start-End: 1128-1943
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaattccaggactgggacacttctgtgattcggacagtctaagcttctaagagtcttcgattctttccctctcgcagaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaa

SEQ ID NO: 175227 - DNA, 2111 bp, Homo sapiens
  Payload ID: 14411
  Gene Symbol: RTN2
  Gene Name: reticulon 2
  ENST ID: ENST00000591286
  CDS Start-End: 231-1061
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggtaagcaacgtgtatgaagatgctgcattggcccacagaaggcaaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaa

SEQ ID NO: 175228 - DNA, 2212 bp, Homo sapiens
  Payload ID: 14411
  Gene Symbol: RTN2
  Gene Name: reticulon 2
  ENST ID: ENST00000587597
  CDS Start-End: 231-1616
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaaggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaa

SEQ ID NO: 175229 - DNA, 2524 bp, Homo sapiens
  Payload ID: 14412
  Gene Symbol: RTN3
  Gene Name: reticulon 3
  Uniprot ID: O95197
  ENST ID: ENST00000341307
  CDS Start-End: 192-917
gtgcgcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaaggatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaa

SEQ ID NO: 175230 - DNA, 4886 bp, Homo sapiens
  Payload ID: 14412
  Gene Symbol: RTN3
  Gene Name: reticulon 3
  Uniprot ID: O95197
  ENST ID: ENST00000339997
  CDS Start-End: 155-3196
gctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggagggattgagctctctttgctctgatgagccatcttcagaaattatgacttcttcctttctttcatcttctgaaatacataacactggccttacaatactacatggagaaaaaagccatgtgttagggagccagcctattttagccaaagaaggaaaagaccacttggatcttctagatatgaaaaagatggaaaagcctcaggggaccagcaacaacgtatcagactcttcagtttctcttgcagcaggagttcattgtgaccgtccttctattccagccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttatacatattctttgtctccatccaaagtttcaggagatgatgttattgaaaaggattcccctgaatcaccatttgaagtaattattgacaaagcagcatttgacaaagaatttaaagactcatataaggagagcacagatgattttggtagctggtctgtgcacactgataaagaatcatccgaagacatttcagagactaatgacaagctttttccactgagaaataaagaggcaggacgttacccaatgtctgcattgctcagtaggcagttttcacacacaaatgcagcactggaagaggtgtccagatgcgtgaatgatatgcataactttactaacgaaatactgacttgggatctggttccccaagtgaaacaacagaccgataaatcttctgactgcatcacaaaaactacaggacttgacatgagtgaatataattcagaaattccagttgtaaatcttaaaactagcactcatcagaaaactcctgtatgttctattgatgggagcactcccatcactaaatcaacaggtgattgggcagaagcatctctccagcaagaaaatgctattactggaaaacctgtacctgactctttgaattccacaaaagaattcagtatcaaaggtgtgcaaggcaatatgcagaaacaggatgacacacttgcagaattacctggatctccacctgagaaatgtgactctttgggttctggagtggccacagtgaaagtggttttacctgatgaccacctgaaagatgaaatggactggcagagctctgcattgggagaaatcacagaagctgatagttctggtgagtctgatgacacagtaatagaggacatcacagcagatacatcatttgaaaataacaaaattcaggctgaaaaacctgtttccattccaagtgctgttgtaaaaacaggtgaaagagaaatcaaagagattcccagttgtgagagagaagaaaaaacatctaaaaactttgaagaattggtcagtgactctgagctgcatcaagatcagcctgatattcttggaaggagtccagctagtgaggcagcatgttcaaaagtacccgatacgaatgtctccttagaagatgtgagtgaagttgctcctgaaaagcctattactactgagaaccccaaacttccttcaacagtgtctccaaatgtttttaatgagacagaattctcattaaatgtgacaacatctgcctatttggagtcattacatgggaaaaatgttaaacatatagatgattcctccccagaggacctgatagcagcctttacagaaaccagagataaaggaatagtagatagtgaaagaaatgcttttaaagcaatatcagagaagatgacagactttaaaacaactcctcctgtagaagtcttacatgaaaatgagtccggtggttctgaaattaaagacattggaagcaaatacagtgaacaaagcaaagaaacaaatggaagtgagcctctaggtgttttccctacccaaggtactccagtagcatctcttgacttagaacaagaacagctcacaattaaggctcttaaagaattaggtgaaagacaggttgagaagtcaacttctgcacagcgtgacgcagaattgccttctgaagaagtactgaagcaaactttcacatttgctccagaatcttggccacagagatcatatgacatcctagaacgtaatgtcaagaatggatctgatcttgggatttcccagaagcccatcactatcagagaaactactagggtagatgctgtttccagccttagcaagactgaattggtaaaaaagcatgtcctagcaagacttctgacagacttctcagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacacaaacaa

SEQ ID NO: 175231 - DNA, 1407 bp, Homo sapiens
  Payload ID: 14412
  Gene Symbol: RTN3
  Gene Name: reticulon 3
  Uniprot ID: O95197
  ENST ID: ENST00000354497
  CDS Start-End: 65-709
ttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgtt

SEQ ID NO: 175232 - DNA, 2645 bp, Homo sapiens
  Payload ID: 14412
  Gene Symbol: RTN3
  Gene Name: reticulon 3
  Uniprot ID: O95197
  ENST ID: ENST00000356000
  CDS Start-End: 188-955
gcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggattcctttgtttcttcctcttcctctcagcctgtatctctattttcgacctcacaagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacacaaacaa

SEQ ID NO: 175233 - DNA, 4937 bp, Homo sapiens
  Payload ID: 14412
  Gene Symbol: RTN3
  Gene Name: reticulon 3
  Uniprot ID: O95197
  ENST ID: ENST00000377819
  CDS Start-End: 155-3253
gctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggattcctttgtttcttcctcttcctctcagcctgtatctctattttcgacctcacaagagggattgagctctctttgctctgatgagccatcttcagaaattatgacttcttcctttctttcatcttctgaaatacataacactggccttacaatactacatggagaaaaaagccatgtgttagggagccagcctattttagccaaagaaggaaaagaccacttggatcttctagatatgaaaaagatggaaaagcctcaggggaccagcaacaacgtatcagactcttcagtttctcttgcagcaggagttcattgtgaccgtccttctattccagccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttatacatattctttgtctccatccaaagtttcaggagatgatgttattgaaaaggattcccctgaatcaccatttgaagtaattattgacaaagcagcatttgacaaagaatttaaagactcatataaggagagcacagatgattttggtagctggtctgtgcacactgataaagaatcatccgaagacatttcagagactaatgacaagctttttccactgagaaataaagaggcaggacgttacccaatgtctgcattgctcagtaggcagttttcacacacaaatgcagcactggaagaggtgtccagatgcgtgaatgatatgcataactttactaacgaaatactgacttgggatctggttccccaagtgaaacaacagaccgataaatcttctgactgcatcacaaaaactacaggacttgacatgagtgaatataattcagaaattccagttgtaaatcttaaaactagcactcatcagaaaactcctgtatgttctattgatgggagcactcccatcactaaatcaacaggtgattgggcagaagcatctctccagcaagaaaatgctattactggaaaacctgtacctgactctttgaattccacaaaagaattcagtatcaaaggtgtgcaaggcaatatgcagaaacaggatgacacacttgcagaattacctggatctccacctgagaaatgtgactctttgggttctggagtggccacagtgaaagtggttttacctgatgaccacctgaaagatgaaatggactggcagagctctgcattgggagaaatcacagaagctgatagttctggtgagtctgatgacacagtaatagaggacatcacagcagatacatcatttgaaaataacaaaattcaggctgaaaaacctgtttccattccaagtgctgttgtaaaaacaggtgaaagagaaatcaaagagattcccagttgtgagagagaagaaaaaacatctaaaaactttgaagaattggtcagtgactctgagctgcatcaagatcagcctgatattcttggaaggagtccagctagtgaggcagcatgttcaaaagtacccgatacgaatgtctccttagaagatgtgagtgaagttgctcctgaaaagcctattactactgagaaccccaaacttccttcaacagtgtctccaaatgtttttaatgagacagaattctcattaaatgtgacaacatctgcctatttggagtcattacatgggaaaaatgttaaacatatagatgattcctccccagaggacctgatagcagcctttacagaaaccagagataaaggaatagtagatagtgaaagaaatgcttttaaagcaatatcagagaagatgacagactttaaaacaactcctcctgtagaagtcttacatgaaaatgagtccggtggttctgaaattaaagacattggaagcaaatacagtgaacaaagcaaagaaacaaatggaagtgagcctctaggtgttttccctacccaaggtactccagtagcatctcttgacttagaacaagaacagctcacaattaaggctcttaaagaattaggtgaaagacaggttgagaagtcaacttctgcacagcgtgacgcagaattgccttctgaagaagtactgaagcaaactttcacatttgctccagaatcttggccacagagatcatatgacatcctagaacgtaatgtcaagaatggatctgatcttgggatttcccagaagcccatcactatcagagaaactactagggtagatgctgtttccagccttagcaagactgaattggtaaaaaagcatgtcctagcaagacttctgacagacttctcagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacac

SEQ ID NO: 175234 - DNA, 735 bp, Homo sapiens
  Payload ID: 14412
  Gene Symbol: RTN3
  Gene Name: reticulon 3
  ENST ID: ENST00000542238
  CDS Start-End: 180-735
gctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggagtccagtctaggatcacactttgtgcctcatcctgtctccttactctcctttaatctgagaattaagattaaaagaatgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttg

SEQ ID NO: 175235 - DNA, 2532 bp, Homo sapiens
  Payload ID: 14412
  Gene Symbol: RTN3
  Gene Name: reticulon 3
  Uniprot ID: O95197
  ENST ID: ENST00000537981
  CDS Start-End: 138-848
agtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacac

SEQ ID NO: 175236 - DNA, 992 bp, Homo sapiens
  Payload ID: 14412
  Gene Symbol: RTN3
  Gene Name: reticulon 3
  ENST ID: ENST00000536011
  CDS Start-End: 138-509
agtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaactggctgtcttcatgtggctgatgacctatgttggtgctgtttttaacggaatcacccttctaattcttgctgaactgctcattttcagtgtcccgattgtctatgagaagtacaaggatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgt

SEQ ID NO: 175237 - DNA, 545 bp, Homo sapiens
  Payload ID: 14412
  Gene Symbol: RTN3
  Gene Name: reticulon 3
  ENST ID: ENST00000545432
  CDS Start-End: 138-545
agtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggattcctttgtttcttcctcttcctctcagcctgtatctctattttcgacctcacaagccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttatacatattctttgtct

SEQ ID NO: 175238 - DNA, 529 bp, Homo sapiens
  Payload ID: 14412
  Gene Symbol: RTN3
  Gene Name: reticulon 3
  ENST ID: ENST00000543552
  CDS Start-End: 138-529
agtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggcaggagttcattgtgaccgtccttctattccagccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttatacatattctttgtctccatccaa

SEQ ID NO: 175239 - DNA, 3124 bp, Homo sapiens
  Payload ID: 14412
  Gene Symbol: RTN3
  Gene Name: reticulon 3
  Uniprot ID: O95197
  ENST ID: ENST00000540798
  CDS Start-End: 142-2904
agtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttatacatattctttgtctccatccaaagtttcaggagatgatgttattgaaaaggattcccctgaatcaccatttgaagtaattattgacaaagcagcatttgacaaagaatttaaagactcatataaggagagcacagatgattttggtagctggtctgtgcacactgataaagaatcatccgaagacatttcagagactaatgacaagctttttccactgagaaataaagaggcaggacgttacccaatgtctgcattgctcagtaggcagttttcacacacaaatgcagcactggaagaggtgtccagatgcgtgaatgatatgcataactttactaacgaaatactgacttgggatctggttccccaagtgaaacaacagaccgataaatcttctgactgcatcacaaaaactacaggacttgacatgagtgaatataattcagaaattccagttgtaaatcttaaaactagcactcatcagaaaactcctgtatgttctattgatgggagcactcccatcactaaatcaacaggtgattgggcagaagcatctctccagcaagaaaatgctattactggaaaacctgtacctgactctttgaattccacaaaagaattcagtatcaaaggtgtgcaaggcaatatgcagaaacaggatgacacacttgcagaattacctggatctccacctgagaaatgtgactctttgggttctggagtggccacagtgaaagtggttttacctgatgaccacctgaaagatgaaatggactggcagagctctgcattgggagaaatcacagaagctgatagttctggtgagtctgatgacacagtaatagaggacatcacagcagatacatcatttgaaaataacaaaattcaggctgaaaaacctgtttccattccaagtgctgttgtaaaaacaggtgaaagagaaatcaaagagattcccagttgtgagagagaagaaaaaacatctaaaaactttgaagaattggtcagtgactctgagctgcatcaagatcagcctgatattcttggaaggagtccagctagtgaggcagcatgttcaaaagtacccgatacgaatgtctccttagaagatgtgagtgaagttgctcctgaaaagcctattactactgagaaccccaaacttccttcaacagtgtctccaaatgtttttaatgagacagaattctcattaaatgtgacaacatctgcctatttggagtcattacatgggaaaaatgttaaacatatagatgattcctccccagaggacctgatagcagcctttacagaaaccagagataaaggaatagtagatagtgaaagaaatgcttttaaagcaatatcagagaagatgacagactttaaaacaactcctcctgtagaagtcttacatgaaaatgagtccggtggttctgaaattaaagacattggaagcaaatacagtgaacaaagcaaagaaacaaatggaagtgagcctctaggtgttttccctacccaaggtactccagtagcatctcttgacttagaacaagaacagctcacaattaaggctcttaaagaattaggtgaaagacaggttgagaagtcaacttctgcacagcgtgacgcagaattgccttctgaagaagtactgaagcaaactttcacatttgctccagaatcttggccacagagatcatatgacatcctagaacgtaatgtcaagaatggatctgatcttgggatttcccagaagcccatcactatcagagaaactactagggtagatgctgtttccagccttagcaagactgaattggtaaaaaagcatgtcctagcaagacttctgacagacttctcagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaag

SEQ ID NO: 175240 - DNA, 2333 bp, Homo sapiens
  Payload ID: 14413
  Gene Symbol: RTN4
  Gene Name: reticulon 4
  Uniprot ID: Q9NQC3
  ENST ID: ENST00000317610
  CDS Start-End: 245-1366
gctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 175241 - DNA, 4790 bp, Homo sapiens
  Payload ID: 14413
  Gene Symbol: RTN4
  Gene Name: reticulon 4
  Uniprot ID: Q9NQC3
  ENST ID: ENST00000337526
  CDS Start-End: 245-3823
gctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 175242 - DNA, 4110 bp, Homo sapiens
  Payload ID: 14413
  Gene Symbol: RTN4
  Gene Name: reticulon 4
  Uniprot ID: Q9NQC3
  ENST ID: ENST00000357376
  CDS Start-End: 183-3143
ctcctcctgtgctcgtggggagctggccgagtggaaaacgtccacattgacccaaccgcagtgaagggagagcgcctccagtggtgtggtgcgtggagaaatgggaaggagagagttctgatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 175243 - DNA, 2390 bp, Homo sapiens
  Payload ID: 14413
  Gene Symbol: RTN4
  Gene Name: reticulon 4
  Uniprot ID: Q9NQC3
  ENST ID: ENST00000357732
  CDS Start-End: 245-1423
gctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 175244 - DNA, 1898 bp, Homo sapiens
  Payload ID: 14413
  Gene Symbol: RTN4
  Gene Name: reticulon 4
  Uniprot ID: Q9NQC3
  ENST ID: ENST00000394609
  CDS Start-End: 330-929
tcttttggtagcctgccctctccctgcaaatgcagctccatttggtatgagcaacaaggcaaatgcctaaaacaatcaacagatagaaggaaagcattaatgctggagtattagtagcctagttacagattgcactgcgtcagactgttccacacccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaagcagatcgtgacaagagatggacggtcagaagaaaaattggaaggacaaggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaata

SEQ ID NO: 175245 - DNA, 4161 bp, Homo sapiens
  Payload ID: 14413
  Gene Symbol: RTN4
  Gene Name: reticulon 4
  Uniprot ID: Q9NQC3
  ENST ID: ENST00000394611
  CDS Start-End: 234-3194
agtccctgccctcccctggggagggtgagtcacgccaaactgggcggagagtccgctggcctcactcctagctcatctgggcggcggcggcaagtggggacagggcgggtggcgcatcaccggcgcggaggcaggaggagcagtctcattgttccgggagccgtcaccacaatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 175246 - DNA, 4061 bp, Homo sapiens
  Payload ID: 14413
  Gene Symbol: RTN4
  Gene Name: reticulon 4
  Uniprot ID: Q9NQC3
  ENST ID: ENST00000405240
  CDS Start-End: 134-3094
aatattgcctgttctacagagttccctaattccatattgatgatacctattgggaaactttagtttttttaatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 175247 - DNA, 1456 bp, Homo sapiens
  Payload ID: 14413
  Gene Symbol: RTN4
  Gene Name: reticulon 4
  ENST ID: ENST00000402434
  CDS Start-End: 77-1114
cacaaccgcccgcggctctgagacgcggccccggcggcggcggcagcagctgcagcatcatctccaccctccagccatggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagct

SEQ ID NO: 175248 - DNA, 4102 bp, Homo sapiens
  Payload ID: 14413
  Gene Symbol: RTN4
  Gene Name: reticulon 4
  Uniprot ID: Q9NQC3
  ENST ID: ENST00000404909
  CDS Start-End: 175-3135
atacggacgccagctgcgggcaaggccaagaccccaccccaactcacggttacccaaagtgggggtggagctcccagctctcagccccgcccattgaacgcaatcccagccgatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 175249 - DNA, 656 bp, Homo sapiens
  Payload ID: 14413
  Gene Symbol: RTN4
  Gene Name: reticulon 4
  ENST ID: ENST00000438462
  CDS Start-End: 1-610
gctttgtctgcggacttcggggcgatggcgccccgtctggttggaagcgcggggagaagggtggggcggcccttggagcccggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaagtaagtatttaaaatctgcagtgtttttactaggataaggtgtgctggat

SEQ ID NO: 175250 - DNA, 589 bp, Homo sapiens
  Payload ID: 14413
  Gene Symbol: RTN4
  Gene Name: reticulon 4
  ENST ID: ENST00000427710
  CDS Start-End: 316-589
agggcctctgaggactgctgcagacacagctgaggcagcccggctccaggctcgctggaggggctgtgtctggggagatgcttctctataaaaagcttagagagagttgtcatcgaaaataacaagactattctggatatgagtaacactgaggaataagatactaagccattaaagaagggtataaaaattatgtctgacacaggatatggagagaaatatgatgaagatgaaatatgacaacagaatcaagatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatact

SEQ ID NO: 175251 - DNA, 955 bp, Homo sapiens
  Payload ID: 14413
  Gene Symbol: RTN4
  Gene Name: reticulon 4
  ENST ID: ENST00000486085
  CDS Start-End: 1-384
ctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagc

SEQ ID NO: 175252 - DNA, 1682 bp, Homo sapiens
  Payload ID: 14414
  Gene Symbol: RTN4IP1
  Gene Name: reticulon 4 interacting protein 1
  Uniprot ID: Q8WWV3
  ENST ID: ENST00000369063
  CDS Start-End: 467-1657
ccggcggctaaggagagcgggcaggcaaggagattccgggccagggtcgcggcggcagtcggcaagcgttcgattctctggcgttggatcgcgagcggtgtctgcttgtcccgccgagggctcccaggacagggcagggatctagggggtttgcgcacctgctttttaatgccccgcccccccttttttttttaaagtggagggggtgaaagtgagggaggagaatggacagaatactgactggaacgttaattcgagcatttcatatgcgaagagcggaataacagttccgtattcttctttcagtttctccattagattagcttcattttcgaatgctccgttttgcatgcttaattttgaaactagcccgtggtttggcagaatttgactgaattcaggggtgagagtttgatccagtccaagtgtatttgaatttgagcacgcagttcaaccagtgtttacaatggaatttctgaagacttgtgtacttagaagaaatgcatgcactgcggtttgcttctggagaagcaaagttgtccaaaagccttcagttagaaggattagtactacctctcctaggagcactgtcatgcctgcttgggtgatagataaatatgggaagaatgaagtgcttcgattcactcagaacatgatgatgcctatcatacactatccaaatgaagtcattgtcaaagttcacgctgccagtgtaaatcctatagacgttaatatgagaagtggttatggagctacagctttaaatatgaagcgtgatcctttacacgtgaaaatcaaaggagaagaatttcctctgactctgggtcgggatgtctctggcgtggtgatggaatgtgggcttgatgtgaaatacttcaagcctggagatgaggtctgggctgcagttcctccttggaaacaaggcactctttcagagtttgttgtagtcagtgggaatgaggtctctcacaaacccaaatcactcactcatactcaagctgcctctttgccatatgtggctctcacagcctggtctgctataaacaaagttggtggcctgaatgacaagaattgcacaggaaaacgtgttctaatcttaggcgcttcaggcggagttggtacttttgctatacaggtaatgaaagcatgggatgctcatgtgacagcagtttgctcccaagatgccagtgaacttgtaaggaagcttggtgcagacgatgtaattgattacaaatctggaagtgtggaagagcagttgaaatccttaaaaccatttgattttatccttgataatgttggcggatccactgaaacatgggctccagattttctcaagaaatggtcaggagccacctatgtgactttggtgactcctttcctcctgaacatggaccgattgggcatagcagatggcatgttgcagacaggagtcactgtaggttcaaaggcattaaagcatttctggaaaggagtccattatcgctgggcatttttcatggccagtggcccatgtttagatgacattgcagaactggtggatgcgggaaagatccggccagttattgaacaaacctttcctttttctaaagttccagaagccttcctgaaggtggaaagaggacacgcacgaggaaagactgtaattaatgttgtttaaataaaaatgcagtttagtgattgtt

SEQ ID NO: 175253 - DNA, 814 bp, Homo sapiens
  Payload ID: 14414
  Gene Symbol: RTN4IP1
  Gene Name: reticulon 4 interacting protein 1
  ENST ID: ENST00000539449
  CDS Start-End: 1-681
atggaatttctgaagacttgtgtacttagaagaaatgcatgcactgcggtttgcttctggagaagcaaagttgtccaaaagccttcagttagaaggattagtactacctctcctaggagcactgtcatgcctgcttgggtgatagataaatatgggaagaatgaagtgcttcgattcactcagaacatgatgatgcctatcatacactatccaaatgaagtcattgtcaaagttcacgctgccagtgtaaatcctatagacgttaatatgagaagtggttatggagctacagctttaaatatgaagcgtgatcctttacacgtgaaaatcaaaggagaagaatttcctctgactctgggtcgggatgtctctggcgtggtgatggaatgtgggcttgatgtgaaatacttcaagcctggagatgaggtctgggctgcagttcctccttggaaacaaggcactctttcagagtttgttgtagtcagtgggaatgaggtctctcacaaacccaaatcactcactcatactcaagctgcctctttgccatatgtggctctcacagcctggtctgctataaacaaagttggtggcctgaatgacaagaattgcacaggaaaacgcatttctggaaaggagtccattatcgctgggcatttttcatggccagtggcccatgtttagatgacattgcagaactggtggatgcgggaaagatccggccagttattgaacaaacctttcctttttctaaagttccagaagccttcctgaaggtggaaagaggacacgcacgaggaaagactgtaattaatgt

SEQ ID NO: 175254 - DNA, 2157 bp, Homo sapiens
  Payload ID: 14415
  Gene Symbol: RTN4R
  Gene Name: reticulon 4 receptor
  Uniprot ID: Q9BZR6
  ENST ID: ENST00000043402
  CDS Start-End: 440-1861
ccgggccagcctaggccgccacaccctcgggcccgcgtccccggccggctccggcccgggccgccatcccctccgccgcctgcaggggccgccgcctcttcaggaatgcgccgcctttgtctgggaccgcgcggcgccggtgcaccgggcgggctgagcgcctcctgcggcccggcctgcgcgccccggcccgccgcgccgcccacgccccaacccccgcgccgccgccgccctcgccctgtgcgccctgcgcgccctgcgcacccgcggcccgagcccagccagagccgggcggagcggagcgcgccgagcctcgtcccgcggccgggccggggccgggccgtagcggcggcgcctggatgcggacccggccgcggggagacgggcgcccgccccgaaacgactttcagtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaa

SEQ ID NO: 175255 - DNA, 1777 bp, Homo sapiens
  Payload ID: 14415
  Gene Symbol: RTN4R
  Gene Name: reticulon 4 receptor
  ENST ID: ENST00000416372
  CDS Start-End: 1-1481
ggtaccgagggtgggtgggggtgtcgggccgcctccaccccagcctcacggtctgggctcagaacctcccgtttctccgagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaa

SEQ ID NO: 175256 - DNA, 1973 bp, Homo sapiens
  Payload ID: 14415
  Gene Symbol: RTN4R
  Gene Name: reticulon 4 receptor
  ENST ID: ENST00000425986
  CDS Start-End: 1-1679
gtgtggaggagggagcaggctgcctgggtggttgtgggacgcgactcctcctaagccctggacacacttgccctccacccccgccctcgggcatccaggcgcccgtttttgagatagacgtgcccagagggaccccagccccattgcagtgtttcctaggccctgtgggtggaacccccactgggaccccccggggactcctgcaatgcgggctctgtgttcactggagtcctgaggaggtacctgcagtcaccagtgtccattccaggaggccttcaaggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttctt

SEQ ID NO: 175257 - DNA, 3625 bp, Homo sapiens
  Payload ID: 14416
  Gene Symbol: RTN4RL1
  Gene Name: reticulon 4 receptor-like 1
  Uniprot ID: Q86UN2
  ENST ID: ENST00000331238
  CDS Start-End: 481-1806
cccgctccgccgatcgctcggtcctgcaaacgcgcgccgggcgctttccccggagctcggcggtgcgtgcgagcgcccttttgctgcagccgcggcggcggtggtccgagggggcggagaggagggggctgcggccggccggccagggggcggcgtcccccctcaaaaccgcctgcgaagtgctccgggtggcagaagcaggccgccggctccgcggagcaagccgctcgccccggggctgagcaagcgcgcggggctgccgggcagcaccacggttgcttgcgggcgccggtgccctcggcgcggggctggagctcaccatgcccctgcggggccgggccaccgggcacgagcggatccccggcttgcccccgcctcgacgcgctcggattagctgcagctggcgcccagggatttgaatctggaccccgggagggagtgcgcctaggccgacctcggagcggcggccccgtggccaacatgcttcgcaaagggtgctgtgtggagttgctgctgctgttggtagctgcggagctgcccctgggtggtggctgcccacgggactgtgtgtgctacccggcgcccatgacggtcagctgccaggcgcacaactttgcagccatcccggagggcatccccgtggacagcgagcgcgtcttcctgcagaacaaccgcatcggcctcctccagcccggccacttcagccccgccatggtcaccctgtggatctactcgaacaacatcacctacatccaccccagcaccttcgagggcttcgtgcacctggaggagctggacctcggcgacaaccggcagctgcggacgctggcacccgagaccttccagggcctggtgaagcttcacgccctctacctctacaagtgtgggctcagcgccttgccggccggcgtctttggcggcctgcacagcctgcagtacctctacctgcaggacaaccacatcgagtacctccaggacgacatcttcgtggacctggtcaacctcagccacctgtttctccacggcaacaagctgtggagtctgggcccgggcaccttccggggcctggtgaacctggaccgtcttttgctgcacgagaaccagctgcagtgggtccaccacaaggcgttccacgacctccgcaggctgaccaccctcttcctcttcaacaacagcctctcggagctgcagggtgagtgcctggccccgctgggggccctggagttcctccgcctcaacggcaacccctgggactgtggttgtcgcgcgcgctccctgtgggaatggctgcagaggttccggggctccagctccgctgtcccctgtgtgtcccctgggctgcggcacggccaggacctgaagctgctgagggccgaggacttccggaactgcacgggaccagcgtccccgcaccagatcaagtcacacacgctcaccaccaccgacagggccgcccgcaaggaacaccactcaccccacggccccaccaggagcaagggccacccgcacggcccccggcccggccacaggaagccggggaagaactgcaccaaccccaggaaccgcaatcagatctctaaggcgggcgccgggaaacaggcccccgagctgccagactatgccccagactaccagcacaagttcagttttgacatcatgcctacggcccggcccaagaggaagggcaagtgtgcccgcaggacccccatccgtgcccccagcggggtgcagcaggcctcctcggccagttccctgggggcctccctcctggcctggacactggggctggcggtcactctccgctgaggacccagggcgtcagcacccagcactgccacatgtccaccaaggaacagaatttattttcttctttttttaacaagtggaagatctgctgggtttcaggaaaaggctggtagagccttcggctgctgtctggacgtctggaccctgccatgtggattataaacccaaagtgtacagccctaggcgggagggggtggcgcttctcagccggctgtcccagccagccccgcagagcgcccacggacagtgtccactctggcaaggtgggaaaaggcactccaagtgcatcctccactggcaacagtgggacaattgcccccgacggcggcaccggggctctgtggaatcccgatcgttccgagaggtctggagggccccgtggttcctggagaaagcaggacgcagagaagaacaaatgaggctcacccacgaggctgggtggccagcagtctgggcacacacgagcaggtggcatcttggctcttgcctgaggccagtcaccctgccctgaattctatcctactccaccttcagcccctccctcgggggtagcgcctctcattcctgatgtctcaggcaaccctggcagacccaggtccaactgctggggtccaagaaccaattaccaaaggaaagatcatcagaggctgaaatctagaacttcatcccgggcaatgaggttctcacagaaggtgcagttttataactaactacgtccacttatatatattcacactctacatatatatatatatatatatatatatatatatatatatatatacacaaatgcacagtccccctcccactccgttacctaactgtacgtcttttcatgtttataaactatacagaaaactgtatttgctgaactaaggattgtattggtgatttctagcaaaaacaaagtgatagaatttttgtctagaatcccaaactggcaacgatagtctccaagggacctggccttgccaagggcctggggcaaggtgtcggcgggacggtgaggaagggggaggcagcaagagtcactttgggggaccaatattcttagatatttagagcatcaccttgtttttatatgcaacacaagcctgtctgccaccctggagcgccctgtcacccctgctgtcgtagctgttggcttcagggtgagaagtgagaagcagcttattgtatatgagggagccaggccccgagggtgagcgagatggagaaggggaaggaaggggctttgggatctggaaaccagcaggccaggcagcatccacagtgttagtccaaagggtcggaccgtgtcgtcagcctagcgtttggtcagtgacggcctggacgggccaaggagactccgggcttgagcccaggcctcccgcacggctcagctgctgaatttttccttgaggctgtttggtgtgtgacccagcaagggccctgtgtgggacagcaggagggaggcgtcgggggccttagcagaaggggaacaatgagggcatttcatgaaccatctcaggcacttctgcatcacggaagacctggccctcccagccgtcctggggatgctcagggtgcaggcagaggctcgggaggccggactcaggggtcagaagcagggactggggcaggcgagcccggacagggaagaggggctccgatcaaagccggccgtgctgctggccgggggcccaggtgggtacaagctcctttgtgctttgcacaaacctgaatcccccaccagagaggatgtgtgtgaggagccagaaacgctgaatccaattaagagagaaaaataataataacaataaatgatcttggacaagaa

SEQ ID NO: 175258 - DNA, 2203 bp, Homo sapiens
  Payload ID: 14417
  Gene Symbol: RTN4RL2
  Gene Name: reticulon 4 receptor-like 2
  Uniprot ID: Q86UN3
  ENST ID: ENST00000335099
  CDS Start-End: 318-1580
tgggcacacggacagacggactgacggactctcgagcggacagcgcagctagcggggcgcgggcgctgggcgtcgacggccagccccagccttccccgccccgtcgcgccccgccccgtcccgtcggggccgatggctcctcccgaggcccgcagcccgggcggcgcagggtagagcgccgcggcccggccacgcagcccggggactcccgggccctcccggagccccgcggggtccccgccgtgcatccggcgggctcagggagcgagtgggagcgccctccccccgctgccccctcccccgagcatcgagacaagatgctgcccgggctcaggcgcctgctgcaagctcccgcctcggcctgcctcctgctgatgctcctggccctgcccctggcggcccccagctgccccatgctctgcacctgctactcatccccgcccaccgtgagctgccaggccaacaacttctcctctgtgccgctgtccctgccacccagcactcagcgactcttcctgcagaacaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctgcatttgtaccgctgccagctcagcagcctgcccggcaacatcttccgaggcctggtcagcctgcagtacctctacctccaggagaacagcctgctccacctacaggatgacttgttcgcggacctggccaacctgagccacctcttcctccacgggaaccgcctgcggctgctcacagagcacgtgtttcgcggcctgggcagcctggaccggctgctgctgcacgggaaccggctgcagggcgtgcaccgcgcggccttccgcggcctcagccgcctcaccatcctctacctgttcaacaacagcctggcctcgctgcccggcgaggcgctcgccgacctgccctcgctcgagttcctgcggctcaacgctaacccctgggcgtgcgactgccgcgcgcggccgctctgggcctggttccagcgcgcgcgcgtgtccagctccgacgtgacctgcgccacccccccggagcgccagggccgagacctgcgcgcgctccgcgaggccgacttccaggcgtgtccgcccgcggcacccacgcggccgggcagccgcgcccgcggcaacagctcctccaaccacctgtacggggtggccgaggccggggcgcccccagccgatccctccaccctctaccgagatctgcctgccgaagactcgcgggggcgccagggcggggacgcgcctactgaggacgactactgggggggctacgggggtgaggaccagcgaggggagcagatgtgccccggcgctgcctgccaggcgcccccggactcccgaggccctgcgctctcggccgggctccccagccctctgctttgcctcctgctcctggtgccccaccacctctgactgcggtgctgagatcgaagaggccagtgtccgatccccgcttcccgtccacccggggctgcggctccggccccagtcgccccaccttccctggccttgctgcctccctttcccctcccagctcctctcctccccggggagcaggccgcctctccttgcctgccccctgggctgtcctgacttgtggcagccccaagagggcgtgtgtggtggctcagccctgccctccccagttctggccattaactcttccccatcccaaggctggggtggggccccccaggcagccgctgacccgcactcctaagggcccacagcggacaccagaggggcttttgtctgcagagcgtcttccaccagcagagcctttggaagctcccccagggagccccacccaggaccctttgggggatgcctcagtcagggccaggctgaccctgacccctgcttaccctagtcccctcaacctcctgacactggaggaatacttttctcctaagtctaccctggacactttttagggcacctggagagaactttcctctccactgtggcccctgcgtggtgaagatcaaaagaagttgtttgggaaaaaaaatttattaaaaaattctattatttta

SEQ ID NO: 175259 - DNA, 582 bp, Homo sapiens
  Payload ID: 14417
  Gene Symbol: RTN4RL2
  Gene Name: reticulon 4 receptor-like 2
  Uniprot ID: Q86UN3
  ENST ID: ENST00000395120
  CDS Start-End: 1-582
atgctgcccgggctcaggcgcctgctgcaagctcccgcctcggcctgcctcctgctgatgctcctggccctgcccctggcggcccccagctgccccatgctctgcacctgctactcatccccgcccaccgtgagctgccaggccaacaacttctcctctgtgccgctgtccctgccacccagcactcagcgactcttcctgcagaacaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctgcatttgtaccgctgccagctcagcagcctgcccggcaacatcttccgaggcctggtcagcctgcagtacctctacctccaggagaacagcctgctccacctacagggtcccctgcccaaaggcctttgcagctgtttttctcacccaccctcaagtctgcccacatcacggtga

SEQ ID NO: 175260 - DNA, 637 bp, Homo sapiens
  Payload ID: 14417
  Gene Symbol: RTN4RL2
  Gene Name: reticulon 4 receptor-like 2
  ENST ID: ENST00000533205
  CDS Start-End: 10-624
cgagacaagatgctgcccgggctcaggcgcctgctgcaagctcccgcctcggcctgcctcctgctgatgctcctggccctgcccctggcggcccccagctgccccatgctctgcacctgctactcatccccgcccaccgtgagctgccaggccaacaacttctcctctgtgccgctgtccctgccacccagcactcagcgactcttcctgcagaacaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctgcatttgtaccgctgccagctcagcagcctgcccggcaacatcttccgaggcctggtcagcctgcagtacctctacctccaggagaacagcctgctccacctacaggggaagaaagaaaagggtaaatctctgttatgcagctggagaatggatgctctgaaaatggaaggaataccagtaattgttattcattgttattattattgatctaattattgtt

SEQ ID NO: 175261 - DNA, 2935 bp, Homo sapiens
  Payload ID: 14418
  Gene Symbol: RAX
  Gene Name: retina and anterior neural fold homeobox
  Uniprot ID: Q9Y2V3
  ENST ID: ENST00000256852
  CDS Start-End: 180-494
aaggcggcagcgggctgagcgctcggccacccccagcgtgcgcagcccgggcgggcttcgcccgcggagcttgacctagggtcgggacccgtcgggttgcaccgccgcactcgggaagacccggcttcgagcctctcctctccgtctccaaagcgccctcccgcctcccggcgctccccatgcacctgccgggctgcgcgccagccatggccgacgggagcttctcgcttgccggccacctgctccgcagcccgggcgggagcacctcgcgacttcacagcatcgaggccatcctggggtttaccaaggacgacgggatcctcggcaccttcccggcggagcggggcgcccggggcgcgaaggagcgggataggaggctgggcgcgcggcccgcctgccccaaggcgcccgaggaaggctccgagccctccccgccgccagccccggcgcccgcccccgagtacgaaggtgtggttccagaaccgacgggctaagtggcggcggcaggagaagctggaagtgtcctccatgaagctgcaggactcgcccctcctctccttcagccgctccccgccctccgcgacgctgtcgcccctcggggcgggcccgggcagcggtggcgggccggctgggggcgcgctgccgctggagtcctggctcgggccgccgctgccgggcgggggcgccacggcgctgcagagcctgccgggcttcgggccgccggcgcagagcctgcctgccagctacacgccaccgccgccgcctccgcccttcctgaactccccgccgttgggccccggcctgcaacctctcgcgccgccgccgccctcctacccgtgcgggcccggcttcggggacaagttcccgctggacgaggcggacccgcgcaacagcagcatcgcggcgctgcgtctgaaagccaaggagcacatccaggccatcgggaagccgtggcaggccctctaggggcactggggaacgtcttgggatccgaccccgggccgaccgcaccgtacccgcatcctctctcccagggacaacccccctccccagctcggcccctctttccctgtcgcctgcagccacccgccaagcatagttcagggccacgcgcctgctcccgatgcacggggagaagggcgactttcaggcctgaggagaggccctctggccgcctcaacgcacttcgcggacctcagccctgcagctggagggcaacaggctgccgggccccgctggccacgccgctcccatcaccgcaggcgctggagcctccaggcccaaacaggctgaagctcctaaacttggccattcccaggaggcttggagacccccagataaccataacagggaagcaggggaggcggaaaaatagagtttgagaaacttttgtataagtagtttcaaactatttgagaggagaattaaagacatgcttgttttgtttcgactctgtttaagcacgctcaggacttggggagaggagtgaatattggggtacgggaggagggtgcgttgacggacagggtgggtcagggaaagaggaggactgagaagaagctcagggtttccttgtgaaaattctagggacacttcgctgcagcagagaatcgtccccattccgaacgcttcggcggcctagaccagaggcgcccttccctggagccggcgtgcgcgcttggggtccggagtggatggggctaaggctcagatgctagcgcgctcccagttcccccgctagccccatagtccagcggcagctgatattttcaagtttgacttcaatagaaagcgtcaagaccaccttccctagggcgagagcgaagtgtcccccggcccctggcgtccccgctctcctaaggactcctctcagttcaccaagcagatctccggttcggtgccagtccctaacacccaaggttgatcaccagcggtacaagaactgaggcaaagagatgcttttccttttcggagccgcgagactctctaacctccccaactcgctccacactcgccaacccagagttcggtaaaaggcgcgtctggtgaggtgccgcgctcggagagtgtcctggagcgccctacgccaccgccccgagagctagttcttgcgggcgtgccctggacagtatctgcagttctttggcgccggctctagggcgaggaaggaatctcgaaatctcagcccgcttcacaatctcctgagactctctgaagaaggagagtcccggactcccgcctgagcgtgctcgatatccaccgttgacactggaagctgggcgaccgccagcagaacctggatgcccgccaacaggtcctggcacggggggggggggggcgtccaccccacaacccccgtccctaagcgtgctttcaggatgatgcccccagagccttaattagcatcaactggctactgtctgtcggtcctgagcaaattagtgaagctcccagtcccctttcctcgtctaaataaactctgtctctctggaaggtgggaaagatggaataagatcacctgtaaaggctttgtggaaagtaccaagaccctggcatgacgcaatatggattgtaatcatcgtccccatttccccgaaattccctggctgttctccggttcctgaaaccgacttgggaaaaggatgaccacgctggagctgggaatatgggaagcctcatcatagtttccagtcctttctctgcgggtctaagaggctattgcataaccagggctgtgtacccctagacctccagatggtgccttgcacacagtaggctgatcagtaaaaatgtactgaataaattattcccccccaagaggtagggagtaatatctgcacttttcctcacaaggatgtctccttgggggaggaggatggagcagcccgtgtgttatcaccttttagcaagaaaacaaaacaaaacaaaaccagaa

SEQ ID NO: 175262 - DNA, 3197 bp, Homo sapiens
  Payload ID: 14418
  Gene Symbol: RAX
  Gene Name: retina and anterior neural fold homeobox
  Uniprot ID: Q9Y2V3
  ENST ID: ENST00000334889
  CDS Start-End: 188-1228
ctgggactaaggcggcagcgggctgagcgctcggccacccccagcgtgcgcagcccgggcgggcttcgcccgcggagcttgacctagggtcgggacccgtcgggttgcaccgccgcactcgggaagacccggcttcgagcctctcctctccgtctccaaagcgccctcccgcctcccggcgctccccatgcacctgccgggctgcgcgccagccatggccgacgggagcttctcgcttgccggccacctgctccgcagcccgggcgggagcacctcgcgacttcacagcatcgaggccatcctggggtttaccaaggacgacgggatcctcggcaccttcccggcggagcggggcgcccggggcgcgaaggagcgggataggaggctgggcgcgcggcccgcctgccccaaggcgcccgaggaaggctccgagccctccccgccgccagccccggcgcccgcccccgagtacgaagcccctcgaccctactgccccaaggagcccggggaggcacggccgagcccagggctgcccgtcgggccagccaccggcgaagcgaaactgtcagaggaggaacagcccaagaaaaagcatcggcggaaccgcacgactttcaccacgtaccagctgcatgagctggagcgcgcgttcgagaagtcccactacccggacgtgtacagccgcgaggagctggccggcaaggtcaacctaccagaggtccgggtccaggtgtggttccagaaccgacgggctaagtggcggcggcaggagaagctggaagtgtcctccatgaagctgcaggactcgcccctcctctccttcagccgctccccgccctccgcgacgctgtcgcccctcggggcgggcccgggcagcggtggcgggccggctgggggcgcgctgccgctggagtcctggctcgggccgccgctgccgggcgggggcgccacggcgctgcagagcctgccgggcttcgggccgccggcgcagagcctgcctgccagctacacgccaccgccgccgcctccgcccttcctgaactccccgccgttgggccccggcctgcaacctctcgcgccgccgccgccctcctacccgtgcgggcccggcttcggggacaagttcccgctggacgaggcggacccgcgcaacagcagcatcgcggcgctgcgtctgaaagccaaggagcacatccaggccatcgggaagccgtggcaggccctctaggggcactggggaacgtcttgggatccgaccccgggccgaccgcaccgtacccgcatcctctctcccagggacaacccccctccccagctcggcccctctttccctgtcgcctgcagccacccgccaagcatagttcagggccacgcgcctgctcccgatgcacggggagaagggcgactttcaggcctgaggagaggccctctggccgcctcaacgcacttcgcggacctcagccctgcagctggagggcaacaggctgccgggccccgctggccacgccgctcccatcaccgcaggcgctggagcctccaggcccaaacaggctgaagctcctaaacttggccattcccaggaggcttggagacccccagataaccataacagggaagcaggggaggcggaaaaatagagtttgagaaacttttgtataagtagtttcaaactatttgagaggagaattaaagacatgcttgttttgtttcgactctgtttaagcacgctcaggacttggggagaggagtgaatattggggtacgggaggagggtgcgttgacggacagggtgggtcagggaaagaggaggactgagaagaagctcagggtttccttgtgaaaattctagggacacttcgctgcagcagagaatcgtccccattccgaacgcttcggcggcctagaccagaggcgcccttccctggagccggcgtgcgcgcttggggtccggagtggatggggctaaggctcagatgctagcgcgctcccagttcccccgctagccccatagtccagcggcagctgatattttcaagtttgacttcaatagaaagcgtcaagaccaccttccctagggcgagagcgaagtgtcccccggcccctggcgtccccgctctcctaaggactcctctcagttcaccaagcagatctccggttcggtgccagtccctaacacccaaggttgatcaccagcggtacaagaactgaggcaaagagatgcttttccttttcggagccgcgagactctctaacctccccaactcgctccacactcgccaacccagagttcggtaaaaggcgcgtctggtgaggtgccgcgctcggagagtgtcctggagcgccctacgccaccgccccgagagctagttcttgcgggcgtgccctggacagtatctgcagttctttggcgccggctctagggcgaggaaggaatctcgaaatctcagcccgcttcacaatctcctgagactctctgaagaaggagagtcccggactcccgcctgagcgtgctcgatatccaccgttgacactggaagctgggcgaccgccagcagaacctggatgcccgccaacaggtcctggcacggggggggggggggcgtccaccccacaacccccgtccctaagcgtgctttcaggatgatgcccccagagccttaattagcatcaactggctactgtctgtcggtcctgagcaaattagtgaagctcccagtcccctttcctcgtctaaataaactctgtctctctggaaggtgggaaagatggaataagatcacctgtaaaggctttgtggaaagtaccaagaccctggcatgacgcaatatggattgtaatcatcgtccccatttccccgaaattccctggctgttctccggttcctgaaaccgacttgggaaaaggatgaccacgctggagctgggaatatgggaagcctcatcatagtttccagtcctttctctgcgggtctaagaggctattgcataaccagggctgtgtacccctagacctccagatggtgccttgcacacagtaggctgatcagtaaaaatgtactgaataaattattcccccccaagaggtagggagtaatatctgcacttttcctcacaaggatgtctccttgggggaggaggatggagcagcccgtgtgttatcaccttttagcaagaaaacaaaacaaaacaaaaccagaa

SEQ ID NO: 175263 - DNA, 473 bp, Homo sapiens
  Payload ID: 14418
  Gene Symbol: RAX
  Gene Name: retina and anterior neural fold homeobox
  ENST ID: ENST00000555288
  CDS Start-End: 252-473
gccggcgctcaagtccgaggggactgggaggagttacaacagatatagacggacaaactaaacgcgaggtccgggacttcgtacaacccagccaagaaaggagtgggtcccgaaaagggagccagcgaggggaaattcaaactgcgacgagtgcggggctgggaagccttcggctgggtctcggcgcttccagggggcacaggccagggtggcggccccgcggagcgccctcccgcctcccggcgctccccatgcacctgccgggctgcgcgccagccatggccgacgggagcttctcgcttgccggccacctgctccgcagcccgggcgggagcacctcgcgacttcacagcatcgaggccatcctggggtttaccaaggacgacgggatcctcggcaccttcccggcggagcggggcgcccggggcgcgaaggagcgggataggaggctgggcgcgcggcccgcctgcccc

SEQ ID NO: 175264 - DNA, 2414 bp, Homo sapiens
  Payload ID: 14419
  Gene Symbol: RAX2
  Gene Name: retina and anterior neural fold homeobox 2
  Uniprot ID: Q96IS3
  ENST ID: ENST00000555633
  CDS Start-End: 328-882
gcgccaggcccgctggggcaggtgtcccgtggaaatcgacggaggggctgccgtgggcggccgtgacagtcacagagaggggaagagaaaacagggacggtgacacacacagagagaaggaagagcagacagaggcacagcaggagacccccccaagcccgaggaggacagcctggggatgcagagcgcatgccggccccagtggagggaaccgatttccccggagccgggaggcaagcctggggctcccctgccctgtccctgccggtagcccccccagccgtctccccaccatctgtcccgctgccgtcccaccaggtgggagccatgttcctgagcccgggcgaggggccggcaaccgagggtgggggtctggggccgggcgaggaggcccccaagaagaagcaccggaggaaccgcaccaccttcaccacctaccagctgcaccagctggagcgggcgttcgaggcctctcactacccggatgtgtacagccgtgaggagctggcagccaaggtgcacctacctgaggtgcgcgtgcaggtgtggttccagaaccgccgggccaagtggcgccgccaggagcggctggagtcaggctcgggtgccgtggcagctccgagactccccgaggccccagcgctgccgttcgcccgccccccggccatgtcgctgcccctggagccctggttgggccccggaccgccggccgtgccaggcctcccccgcctcctgggcccgggcccggggctgcaagcgtccttcgggcctcatgcctttgctcccaccttcgcagatggcttcgccctggaggaggcgtccctgcggctgctggccaaggaacatgcacaggctctggacagggcctggccgccagcctgagcctgccgccctcccgggccccctcctcggcccaacccgagaaccggggacgtgccctggtgacagccaccacgccttggcctaggccgaggtcatggagcaaccgtggtcaggccaggccaccaccactggggagcgggaccagagagacaggctgctgggttccctgcccccatcccgtctcccaccccatcgccacccgtcctgctggcagcggactggcccccagtgtcaggcaggaggtgacccaagtattctcaggccaggtgcggggacctcctcccctcctggggcctcagtctcctgtctgttaattgggcgtgggggcctccgaggttcgagggctgcgaggctgtgggtggcgggaccgctgactctgtaagatgagtgtaaatctctctgcttctcctaatccccatcagcagagctgcccactctccaggctcccagtcccctggaaataacaaatagcagcagctcccgcgagcctggtctcctctcaccgtgtgctcgccatgtgagcactcccctctccgttgtgccctggacctcgggcacagctgtcagcccattctatagagagggaaaccggggcttaggcaggaagccaggtccccaaagtcgcacggccaggagtggatggagctgcctttcagacccatcaccggtcctaccgtccggggcacagcgacaggttctggagagagggtgggtcccgggccaggtgctggtgggcctccaggtggaggcgggctgatgctgggtgtgtcgtcatcgtcagaccgttcctcacgtccccacagaccccaggccctgtgcatgtccccagtggaggcatggccagcatctgctctgtccaacccagccgcatcgcccaagagctctgagcaaggaggctgtcgcggggccgagaacccgctgggactggcaagcacggctggcccagtgcagcaggagggggccctgaggcatgggatgggacagtctgggccagcgccacctcccgggacagaagtgcggcaccagggcaggagctgcagtagctaccctccccgtctccagcctgggctccccagatcactcccagatcaccaggtcaccccatctctaggcggcacctcacacaccagtcctgtggtccaacgccccgccatcacccaatgtcaccgcacaccaggcagtggggacacggcagtaagcacaagaaagatttttttttttaaagctaaaccaggccaggtgcggtggctcatgcctgtaatcccagtgctttgggaggctgaggtgggaggattgcttgagaccagcctgggtgacacagcaagaccccatctccacaaacgtttttaaaatgtgccgggtgtactggtgcacacctgtcatcccagctacccaagaagctgaggcaagaggatcacttgagcccagaaggtcgaggctgcagggagctgtgatcacactgctgcactccagcctgtgcaacagagccagaccctgactcaatacaaataaaaaacaaatctaaaacaaaa

SEQ ID NO: 175265 - DNA, 2145 bp, Homo sapiens
  Payload ID: 14419
  Gene Symbol: RAX2
  Gene Name: retina and anterior neural fold homeobox 2
  Uniprot ID: Q96IS3
  ENST ID: ENST00000555978
  CDS Start-End: 59-613
cgctggggcaggtgtcccgtggaaatcgacggaggggctgccgtgggcggtgggagccatgttcctgagcccgggcgaggggccggcaaccgagggtgggggtctggggccgggcgaggaggcccccaagaagaagcaccggaggaaccgcaccaccttcaccacctaccagctgcaccagctggagcgggcgttcgaggcctctcactacccggatgtgtacagccgtgaggagctggcagccaaggtgcacctacctgaggtgcgcgtgcaggtgtggttccagaaccgccgggccaagtggcgccgccaggagcggctggagtcaggctcgggtgccgtggcagctccgagactccccgaggccccagcgctgccgttcgcccgccccccggccatgtcgctgcccctggagccctggttgggccccggaccgccggccgtgccaggcctcccccgcctcctgggcccgggcccggggctgcaagcgtccttcgggcctcatgcctttgctcccaccttcgcagatggcttcgccctggaggaggcgtccctgcggctgctggccaaggaacatgcacaggctctggacagggcctggccgccagcctgagcctgccgccctcccgggccccctcctcggcccaacccgagaaccggggacgtgccctggtgacagccaccacgccttggcctaggccgaggtcatggagcaaccgtggtcaggccaggccaccaccactggggagcgggaccagagagacaggctgctgggttccctgcccccatcccgtctcccaccccatcgccacccgtcctgctggcagcggactggcccccagtgtcaggcaggaggtgacccaagtattctcaggccaggtgcggggacctcctcccctcctggggcctcagtctcctgtctgttaattgggcgtgggggcctccgaggttcgagggctgcgaggctgtgggtggcgggaccgctgactctgtaagatgagtgtaaatctctctgcttctcctaatccccatcagcagagctgcccactctccaggctcccagtcccctggaaataacaaatagcagcagctcccgcgagcctggtctcctctcaccgtgtgctcgccatgtgagcactcccctctccgttgtgccctggacctcgggcacagctgtcagcccattctatagagagggaaaccggggcttaggcaggaagccaggtccccaaagtcgcacggccaggagtggatggagctgcctttcagacccatcaccggtcctaccgtccggggcacagcgacaggttctggagagagggtgggtcccgggccaggtgctggtgggcctccaggtggaggcgggctgatgctgggtgtgtcgtcatcgtcagaccgttcctcacgtccccacagaccccaggccctgtgcatgtccccagtggaggcatggccagcatctgctctgtccaacccagccgcatcgcccaagagctctgagcaaggaggctgtcgcggggccgagaacccgctgggactggcaagcacggctggcccagtgcagcaggagggggccctgaggcatgggatgggacagtctgggccagcgccacctcccgggacagaagtgcggcaccagggcaggagctgcagtagctaccctccccgtctccagcctgggctccccagatcactcccagatcaccaggtcaccccatctctaggcggcacctcacacaccagtcctgtggtccaacgccccgccatcacccaatgtcaccgcacaccaggcagtggggacacggcagtaagcacaagaaagatttttttttttaaagctaaaccaggccaggtgcggtggctcatgcctgtaatcccagtgctttgggaggctgaggtgggaggattgcttgagaccagcctgggtgacacagcaagaccccatctccacaaacgtttttaaaatgtgccgggtgtactggtgcacacctgtcatcccagctacccaagaagctgaggcaagaggatcacttgagcccagaaggtcgaggctgcagggagctgtgatcacactgctgcactccagcctgtgcaacagagccagaccctgactcaatacaaataaaaaacaaatctaaaacaaaa

SEQ ID NO: 175266 - DNA, 4266 bp, Homo sapiens
  Payload ID: 14420
  Gene Symbol: RD3
  Gene Name: retinal degeneration 3
  Uniprot ID: Q7Z3Z2
  ENST ID: ENST00000367002
  CDS Start-End: 1165-1752
ttcatgcccattacagtattcccatgcccctcacagggcagtgtgcatctgttttagtgctacctaatgtctgttaggtgcaagctggcccacacatggcttctaggcagaacagtctacaagtgacagcgtgaccagagagcagagacaggaaggaggcccagacatgagtgtgggatgctgcagaacagcaacaggatgcttctgctatccccaaatgttatctcaaatacctcaacgtcaatgctttctgttccatgttcctcttctccctggacagcccctccttctgaaagtcagaactgtctgctcttgagcttgccttgagggaaggaaataatttagataagcagagaggaagacaggcaagggatgtggtggggcaaaggcggagatgtatcttcacaggtccctgtcctcagcacccagaatcaccccttccctgtaggagggagctgatagaaagaggggatctccatccaggagccacccaccaggcagctggaaacatttgccaacagcaggtacacctagggctcagcagagggttgggtgagaatggtcttgcccagtttgtgccacactgagcaccggctggaggaggaagcggacagaatgccatctggacacaagtgctccctcactgcctgggcctgggtcgcctcaggcttttgtgtcagatcagccactccctctacagataatgctgctccaggcaaagaggcttaggtgggtctccagggcaaccgcagctcaggagctggcccgcctccatggttcatcagggaagctgtggctccagcctcgcgggatacatacacgcatacacacacacacacacacacacacacacacacacacacacacacctacacaccccacaaacaatagtccaggctggatctctcctcctgtctcttctcttggtaaaacttctcagagaaccaaagagaggcaaaatttgaggccagccggcagcagcagagaagctgagggagacttgaggatgtagactgccctgccctgctgtggctgctcaactttctttttttttcctgaaaatatccagacactctcttctcccagactgggaagcagaacgcaggccccctgctgtgacgctgcacctgagcagaggctgacctcagagcagggccaggggctatgtctctcatctcatggcttcggtggaacgaggccccatcccggctgtccaccaggagccctgctgagatggtgctggagacgcttatgatggagctgacggggcagatgcgagaggctgagaggcagcagcgggagcgcagcaatgcggtcagaaaggtctgcaccggtgtggactacagctggctggccagcacaccccggtccacctatgacctcagccccattgagcggttgcagctggaagatgtctgcgttaagatccacccatcctattgtgggcctgctatcctcaggttccggcagctgctggcggagcaggagcccgaggtgcaggaggtgtcccagctcttccgctcggtgctgcaggaggtcctggagaggatgaagcaggaagaggaggcccacaagctgacgcgccagtggagcctgcggccccgcggcagcctggccaccttcaagacccgcgcgcgcatctcgcccttcgccagcgacatcaggaccatctccgaggacgtggagcgggacacaccgccgccactgcggtcctggagcatgcccgaattccgggcgcccaaagccgactgaccccggccgcttccctgcccagaagcggagccttctgcagggggaatgataggccggtgaccggagcgccgggccctggaacctccccacctaggcctgacgaggagacccaagaggcggccccatcccaagacgctgctataaaatgaagcgactccctgccccatcctcttcctctggccacaaagctgagttaggtcgtagagcggcaccgccctctccctctcctgcgctagtctgcaggagcagccccttccctaactggcagattcaaggttttggaagacagaccattgccccatcctcatctcctggttctgtctaaaaggggacagttgccctgccttttggcaagacctaggttctcaccccaatttcagggatgtcccattcacccccctacccccatccccaatgagaagggacctgttggctggtatgccttcttgctagtgactggctgagctcaccactgcaggtgggtcacacacagcctcataggcaggcacagctggaagggaccagagagacatttagatccactctcttcagctagtaaatgtggaacttgaggctcagagagggacacttcttctgcctttaactgcagccagctcctcatgaacagtgagattgttcctgcatgaatagtgtctgttcctgagtttggaatcctgggctatgaagggacaggtccaaaggctacatctctacctacctgtggcctgatccatctcttaccttggcagtgggatgagaatctaagctgctctccaagaagtgtagctaggggtggaggtaggttactcattaccccacgccacaatgtcatcgcatgggctgtggccagtccctaacagcttcttccagaggctcagctccaaggacttcagatgctgccctaaagagcccaggtttctcaattccagggttccgctttctgcagctggtcacacctgctctctggctttctccagaaagtgatgcccaaacccctgactgaccttgaggcagctgagtgaaatgttctagaagagcttcctgcagcttcattgtccttcccttttctaacatggttaggccttgatgatgggcatgtggattacccaatgtgtggatcacccatggaaaatctggaaggccaggaggccttcccacacactctggggttgaagtggggtgtaagggggatgggtggggaagtgtctaccctcaactaccagcacacatgcagaaaatgcaagtggaccttaatagtagcctaaataaaatacccggaggagatataatcaacaggggggaaaagtgtgtattccctcagtggaaaaaagtttttttgaatgatttggttttgaacttcccttttgaagtttttttggattttcacttgaatctggacagagaatcataggatggtggaaaacctctgatccaacactatcaagatgaaagagttgattggcttattaatgtaattggtagaagttgagaatcacttaaaatatacatcttaaacatcttacgtattttatttgaagacataaaaagttcacttggttgccaaacttttttttttttttttgagactgagtctcactctgttacccaggctgcagtgcagtggcgtgatctcggctcaccacaacctttgcctcccgggttcaagtgattcttctgcctcagcctcctaagtagctgggactacaggcacgtgccatcaccccagctaatttttgtatttttattagagatggggtttcactatgttgcccagaatggtcttgaactcctgacctcgtgatccactcgccttggcctcccaaagtgctgggattacagacatgagccactgtgcctggctgccaaacttttgatgtgggtccaagctgtgcttttttgtgacctatatgttttgtctggtgggagttctacacttaagttttcttggtttgcactttaatcataacaataagaacaactggcgtaaaagagttttggaacaagcagaagtgacccttggtaagcagactgctcagctggtaggggcaaaagtgttgggggaggattagaaaaaggcctccacattgtgggctttccgggtgccctggatgtgggtcagcaaatgttttagaggaagtagttaacctggagggagattcaaaggaggctggataagagaatgtctatttttctccttccctatcaccttacatgtacctattctccccaaagagaaggaagaccttaggctttcaatgtggtgttctttcttaagtttaagtaactggctgccaatgaaaaccttcccttcgagccgcaggcatgtggacagaatccaccaccctccttagacactcctcagactactacaggctatccccagctggtggctctcaaattcatgagggtccagaagttgttcctctggattcaggttgttaaagggactaatgaggtctgcttccattactattattgaaacctcaataaccacaaataaaagaacaaaaagtt

SEQ ID NO: 175267 - DNA, 1201 bp, Homo sapiens
  Payload ID: 14421
  Gene Symbol: RD3L
  Gene Name: retinal degeneration 3-like
  Uniprot ID: P0DJH9
  ENST ID: ENST00000557640
  CDS Start-End: 225-821
attaatgagcattctctccaaatgaagacatcacagcctcattcctaacacagaaagttatttatttcaaatacagtttcggtgggtaaataaggtggcgcattccttctacagaggacacacctaggagagcaagatacgtcccagtgaaacacagcttcgtcaccaacttcagtcaactctttggcaacatcacatcagcccatcaacttaacaggctaaaaatgccactttttggctggatgaaatggcccaaaaacgattcctacaaacccacacactatcctggctcagacatagtgacaaagactctgcttcgggaattaaaatggcacctaaaggagcgagagagattaatacaagaaatcgaaaatgaacaaaaagtgaaaaaaacaggtgtggattacaactggctcagaaactaccagaatccccacacaactatcccagtgactgaacaaagacaacttgaagttctttgctcacaagttcaaccttgccaaactggaactattctcagcagatttcgagaagttttggcagaaaatgatgtactgccatgggaaatagtctacatcttcaagcaagttctgaaagacttcctaagcagctctgacagagggagtgagcaagaggacctggaggactcagggagcatggactgctctgctccttctgtgatccaaggtgacagctccaagagggcagacaaagatgaaatacccaccatttccagttacgtagacaaaaacacaaaggacaggttcccagtgttctcacacagaatatggaacctaccatattatcacccatctagttaagttacttacaactagaggggtttttatgaacaccttagaactcctaatattaagaataagaaaaagtgatgtgacttcaagtttttctttgttacaaggtcagtatcctgtggatgtagcctatgttttaaatagtgttctttttttaaccactctaaacatgctatgttttcattgaatagtatgcttttaactaaaatgtttcctaagtattttgaaaaaatgtttgcagtattttcttatacctcaaacccacctcacaggaactaaagcaactttagtatgaagtctgacaaattctgtacaaaacttagatattaaccttgacttttattctacaatgaagctacatatagaattaaataaattattaatacgaa

SEQ ID NO: 175268 - DNA, 1349 bp, Homo sapiens
  Payload ID: 14422
  Gene Symbol: RGR
  Gene Name: retinal G protein coupled receptor
  Uniprot ID: P47804
  ENST ID: ENST00000358110
  CDS Start-End: 39-800
agagacagctgggccactggcagtgagggagagtgaggatggcagagaccagtgccctgcccactggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtgcccgccctcattgccaaaatggtgcccacgatcaatgccatcaactatgccctgggcaatgagatggtctgcaggggaatctggcagtgcctctcaccgcagaagagggagaaggaccgaaccaagtgagcctgccaccctggagtgagccccaggccaggaggctgttccaggagtcctgcccagcagcctcagtggccaagcccagacactcacccaccttccccagtggccccgtggatcctggtcctaggctggacacaggattcagaaagacaccaggctgcacagaaagagccagatggacctgagtgtcggtcacagccccctacactcaaggctgagaggcctcaggaaagtcattcctttttaaaaataataataaatgtaagggggtacagtgcagttttgttacatggatagattgcctagtggtgaagtctgggcttttagtgtaaccatcaccctaataatatacgttgtacccattaagttatttctcatccctcaccccctcccaccttgtcacccttctgagtctccaatgtctattattccacactccatgtccacgtgtacacattatttagctcccacttacaagtgagaacatgtggtatttgactttctgtttttgagttatttcacttaaaataatgacctccagtttcatccatg

SEQ ID NO: 175269 - DNA, 2247 bp, Homo sapiens
  Payload ID: 14422
  Gene Symbol: RGR
  Gene Name: retinal G protein coupled receptor
  Uniprot ID: P47804
  ENST ID: ENST00000359452
  CDS Start-End: 39-926
agagacagctgggccactggcagtgagggagagtgaggatggcagagaccagtgccctgcccactggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccgtgtctcccacaggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtaaacaccactctgccagcaaggacgctgctgctcggctggggcccctatgccatcctgtatctatacgcagtcatcgcagacgtgacttccatctcccccaaactgcagatggtgcccgccctcattgccaaaatggtgcccacgatcaatgccatcaactatgccctgggcaatgagatggtctgcaggggaatctggcagtgcctctcaccgcagaagagggagaaggaccgaaccaagtgagcctgccaccctggagtgagccccaggccaggaggctgttccaggagtcctgcccagcagcctcagtggccaagcccagacactcacccaccttccccagtggccccgtggatcctggtcctaggctggacacaggattcagaaagacaccaggctgcacagaaagagccagatggacctgagtgtcggtcacagccccctacactcaaggctgagaggcctcaggaaagtcattcctttttaaaaataataataaatgtaagggggtacagtgcagttttgttacatggatagattgcctagtggtgaagtctgggcttttagtgtaaccatcaccctaataatatacgttgtacccattaagttatttctcatccctcaccccctcccaccttgtcacccttctgagtctccaatgtctattattccacactccatgtccacgtgtacacattatttagctcccacttacaagtgagaacatgtggtatttgactttctgtttttgagttatttcacttaaaataatgacctccagtttcatccatgttgctgcaaaagacatgatctcgttcttttttatggcagtgtagtattccattccatatacatatataaacgttatatatatgtaacgttttctttatccaatcatctgttgatggatagattccatatctttgctactgtaaacagctgtgataagcatacaagtgcaggtttctttttgatatactgatttcttttcctttgggtagataccagtagtaggactgctggatcaaatggtagctctatttttaagacagtatggagaaatcaccatactgttttccataggggttgtactaatttacagtcccaccaacagtgtataggtgttcccttttctctgcatccttaccaatatctgtaattttttgactttttaataatagccattctcacttgtgtgagataaggtctcattgtggttttaatttccatttctctgatgacttttgatgttaagcattttttcatatgcttcttagccacgtgtatgtattctttttgaaaaaatgtttattcatgtcttttgcccactttttaatggcattatttggattttttttgttgagttatttgagtttcttatatattctggataatagtctggataatatattctggataatatataatagtcttatatattctggatatattctggatacatggtttgcaaatattttctccggttctgcacgttgttcattctgttgatggtttattttgctgtgcagaaacttttttagtttaattaagtcccatttgtcta

SEQ ID NO: 175270 - DNA, 868 bp, Homo sapiens
  Payload ID: 14422
  Gene Symbol: RGR
  Gene Name: retinal G protein coupled receptor
  ENST ID: ENST00000372092
  CDS Start-End: 6-368
tgaggatggcagagaccagtgccctgcccactggcttcggggagctcgaggtgctggctgtggggatggtgctactggtggaagaccccggagctgcggactccctgccacctactggtgctgagcttggctcttgcggacagtgggatcagcctgaatgccctcgttgcagccacatccagccttctccgtgtctcccacaggcgctggccctacggctcggacggctgccaggctcacggcttccagggctttgtgacagcgttggccagcatctgcagcagtgcagccatcgcatgggggcgttatcaccactactgcacccgccaaaatgctgccatcggtctcatcattttgagtggcgataggttagccctcttgtccacttggcctcagagcacttctcccactccttacatcccagcccctgcccctaatgctcccttggaccatcttatacacacacacacacacacacacacacacacacacacaccaccttctcagatagcaacaggcttctctgcctcaatatagaacagttaatccctgtgccagaggccttagatcaaagccctttctatactgagagcatggcagagcagtgtgaaggcaggcaaaggggaatgaggaggtctgaattcatctactccatccctgggtggttgtaggcatgtcaccttggccatctgtttctaaagctgaaagtctgaggcagcacaatggtccaggtagatattaattattgtgcccacagagaattgtttgaacctggaaggcagaggttgcagtgagctgagatggcaccactgcactccagcctgggcaacagaatgagactccgcctcaataaaaaaaaaaaaaaaaa

SEQ ID NO: 175271 - DNA, 1878 bp, Homo sapiens
  Payload ID: 14423
  Gene Symbol: ROM1
  Gene Name: retinal outer segment membrane protein 1
  Uniprot ID: Q03395
  ENST ID: ENST00000278833
  CDS Start-End: 542-1597
acaaacaggcgccggacgcggagccgccaggaagcgcgggagggggggcgggcccgagggggggccgggccgcttggtaacccctccctgtccgggcctcgccgctcagtacgggggcggggctagccggctgaccccctggcctactcccggcctccggctccaggcccttcccggatccccgcccccggattcccaggggacggggaagggagcgcccgccccgatatctccgccccccagcccctaacccctcagggttgagcggaccaaccccaccacttccgcgaggggcaggggcggggtcacaaaacgggccctcggcctaggggcggagtttctcgtaaggggcaaggccaaggcatcttgtattggggctgacaggggggcgggttattagggctgaggatgggaggatgctcagggtattggggtcagggtggcattagcccagctcaagccgggccgggctgactcagcatcctgccccagccagcttccatccctgacacctctgcattcccttgggcagagatgggagatggcgccggtgttgcccctggtgctgcccctgcagccccgcatccgcctggcacaagggctctggctcctctcctggctgctggcgctggctggtggcgtcatcctcctctgtagtgggcacctcctggtccagctaaggcaccttggcaccttcctggctccctcctgtcagttccctgtcctgccccaggctgccctggcagcgggcgcggtggctctgggcacaggactagtgggtgtaggagccagccgggcaagtctgaatgcagctctataccctccctggcgaggggtcctgggcccgctgctggtggctggcacggctggtgggggggggctcctggtcgtcggcctcgggctagccctggctttgcctgggagtctggatgaggcgctggaggagggcctggtgactgccttggctcactacaaggacacagaggtgcctgggcactgtcaggccaaaaggctggtggatgagctgcaactgaggtaccactgctgcgggcgccacgggtacaaggattggtttggggtccagtgggtcagcagccgttacctggatcccggtgaccgggatgtggctgaccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactgggtagcatgctggctgtcaccttcctactgcaggctctggtgctccttggcctgcggtacctgcaaacagcactggaggggcttggaggggtcattgatgcgggaggagagacccagggctatctctttcccagtgggctgaaagatatgctgaaaacagcatggctacagggaggggttgcctgcaggccagcacctgaggaggccccaccaggagaagcacctcccaaggaggatctatctgaggcctagaggcctggagcttggggtgaggaagagggagggatggacaagtctgaaaacctcacaactccttaccaaggctccaggttggggggatcgtaggattagaggggctaaggatagtcagcgagctggactggggtaagaaagaaaaccagatgtcctagggcctagcccttgtagtcagaaccaccagggaacagcaaagaacagagtgatgggaaagtgacatgagaaggcctggaggctgattctgatatagactcaataaagtttttggatggaagcaa

SEQ ID NO: 175272 - DNA, 862 bp, Homo sapiens
  Payload ID: 14423
  Gene Symbol: ROM1
  Gene Name: retinal outer segment membrane protein 1
  ENST ID: ENST00000534093
  CDS Start-End: 174-491
gcgagaaacctggcaaagctcccttcctgctgccgtctcagcctccgcaaagactgggagtaccatggagtaccgggggggaaatatggagtactgccgaggaacgtgggagccacagagagaggcgccgcactgccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactgggtagcatgctggctgtcaccttcctactgcaggctctggtgctccttggcctgcggtacctgcaaacagcactggaggggcttggaggggtcattgatgcgggaggagagacccagggctatctctttcccagtgggctgaaagatatgctgaaaacagcatggctacagggaggggttgcctgcaggccagcacctgaggaggccccaccaggagaagcacctcccaaggaggatctatctgaggcctagaggcctggagcttggggtgaggaagagggagggatggacaagtctgaaaacctcacaactccttaccaaggctccaggttggggggatcgtaggattagaggggctaaggatagtcagcgagctggactggggtaagaaagaaaaccagatgtcctagggcctagcccttgtagtcagaaccaccagggaacagcaaagaacagagtgatgggaaagtgacatgagaaggcctggaggctgattctgatatagactcaata

SEQ ID NO: 175273 - DNA, 587 bp, Homo sapiens
  Payload ID: 14423
  Gene Symbol: ROM1
  Gene Name: retinal outer segment membrane protein 1
  ENST ID: ENST00000525947
  CDS Start-End: 286-587
ccagccgggcaagtctgaatgcagctctataccctccctggcgaggggtcctgggcccgctgctggtggctggcacggctggtgggggggggctcctggtcgtcggcctcgggctagccctggctttgcctgggagtctggatgaggcgctggaggagggcctggtgactgccttggctcactacaaggacacagaggtgcctgggcactgtcaggccaaaaggctggtggatgagctgcaactgagccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactgggtagcatgctggctgtcaccttcctactgcaggctctggtgctccttggcctgcggtacctgcaaacagcactggaggggcttggaggggtcattgatgcgggaggagagacccagggctatctc

SEQ ID NO: 175274 - DNA, 584 bp, Homo sapiens
  Payload ID: 14423
  Gene Symbol: ROM1
  Gene Name: retinal outer segment membrane protein 1
  ENST ID: ENST00000525801
  CDS Start-End: 409-584
gaatgctcgtccagaggggaggagacggtggtaaaggatcaagggcctccttctggcagggcaggcgagaaacctggcaaagctcccttcctgctgccgtctcagcctccgcaaagactgggagtaccatggagtaccgggggggaaatatggagtactgccgaggaacgtgggagccacagagagaggcgccgcactggtgagggcagggaccgcagccctccccacgcgcccccagcaagctcaggtctccagcgaaagctgagtaactgagccgggggaacaccaggagagagaacggggtgcgggaatggagtcatactgaggacccagagtacaagaaaagagatccagagtgacaggagagagtccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactg

SEQ ID NO: 175275 - DNA, 1455 bp, Homo sapiens
  Payload ID: 14424
  Gene Symbol: RRH
  Gene Name: retinal pigment epithelium-derived rhodopsin homolog
  Uniprot ID: O14718
  ENST ID: ENST00000317735
  CDS Start-End: 35-1048
attatgaagggtgtttcggtatcttccctccaaaatgctaagaaataatttaggcaacagttcagactctaaaaatgaagatggctcggtcttttcacagactgaacacaatattgttgcaacttacttgattatggcaggtatgataagtattatcagcaacataatagttctgggcatcttcattaagtacaaggaacttcggacacccacaaatgcaattattattaacctggctgttactgatataggggtcagtagcattggctatcccatgtctgctgcctcagatctgtatggaagttggaaatttggatacgcaggctgtcaggtttatgctggattgaatattttttttggaatggcaagcattggattactcacggtcgtggctgtggaccgatacctgaccatctgccttcctgacgtagggagaagaatgaccaccaacacttacatcggcttgattctgggagcctggatcaatggcctgttttgggctttgatgcctatcatagggtgggctagttatgccccagatcctactggtgctacgtgtaccataaactggaggaaaaatgatagatcttttgtgtcttacaccatgacagttattgcgataaattttattgtgcccttgacagtgatgttttactgctattaccatgtcacgctatccattaaacatcacactaccagtgactgcactgagtccctcaacagagactggtcagatcagatagatgtaacaaagatgtctgtgatcatgatctgcatgtttctggtggcatggtccccttattccatcgtgtgcttatgggcttcttttggtgacccaaagaagattcctccccccatggccatcatagctccactgtttgcaaaatcttctacattctataacccctgcatttatgtggttgctaataaaaagtttcggagggcaatgcttgccatgttcaaatgtcagactcaccaaacaatgcctgtgacaagtattttacccatggatgtatctcaaaacccattggcttctggaagaatctgaaataagataaaaggacacactatcaaaacactttagttttttgacaatgcttttcttttaaatatgagcccatttagatcaagtgcagacatggatcattgtcctatgagagtgtaagctcctcaagcacagctcgtgcttctgtttgtgcactctggctgctgtagtgtatgcttctctgtgtcctgatatatcaacttattgctcatctcctttgatgaattaggcatcagaggttaaggtcccctttctttctccctattatggcatgcattacactgtactgatgacctttaacttgcctggctcctccattagaataaaagcagtcactaatttaatgttagaataaatgaataattctagataattactgaaatgagttgttggatgttcccagttagaat

SEQ ID NO: 175276 - DNA, 2610 bp, Homo sapiens
  Payload ID: 14425
  Gene Symbol: RPE65
  Gene Name: retinal pigment epithelium-specific protein 65kDa
  Uniprot ID: Q16518
  ENST ID: ENST00000262340
  CDS Start-End: 55-1656
tccttcttcattctgcagttggtgccagaactctggatcctgaactggaagaaaatgtctatccaggttgagcatcctgctggtggttacaagaaactgtttgaaactgtggaggaactgtcctcgccgctcacagctcatgtaacaggcaggatccccctctggctcaccggcagtctccttcgatgtgggccaggactctttgaagttggatctgagccattttaccacctgtttgatgggcaagccctcctgcacaagtttgactttaaagaaggacatgtcacataccacagaaggttcatccgcactgatgcttacgtacgggcaatgactgagaaaaggatcgtcataacagaatttggcacctgtgctttcccagatccctgcaagaatatattttccaggtttttttcttactttcgaggagtagaggttactgacaatgcccttgttaatgtctacccagtgggggaagattactacgcttgcacagagaccaactttattacaaagattaatccagagaccttggagacaattaagcaggttgatctttgcaactatgtctctgtcaatggggccactgctcacccccacattgaaaatgatggaaccgtttacaatattggtaattgctttggaaaaaatttttcaattgcctacaacattgtaaagatcccaccactgcaagcagacaaggaagatccaataagcaagtcagagatcgttgtacaattcccctgcagtgaccgattcaagccatcttacgttcatagttttggtctgactcccaactatatcgtttttgtggagacaccagtcaaaattaacctgttcaagttcctttcttcatggagtctttggggagccaactacatggattgttttgagtccaatgaaaccatgggggtttggcttcatattgctgacaaaaaaaggaaaaagtacctcaataataaatacagaacttctcctttcaacctcttccatcacatcaacacctatgaagacaatgggtttctgattgtggatctctgctgctggaaaggatttgagtttgtttataattacttatatttagccaatttacgtgagaactgggaagaggtgaaaaaaaatgccagaaaggctccccaacctgaagttaggagatatgtacttcctttgaatattgacaaggctgacacaggcaagaatttagtcacgctccccaatacaactgccactgcaattctgtgcagtgacgagactatctggctggagcctgaagttctcttttcagggcctcgtcaagcatttgagtttcctcaaatcaattaccagaagtattgtgggaaaccttacacatatgcgtatggacttggcttgaatcactttgttccagataggctctgtaagctgaatgtcaaaactaaagaaacttgggtttggcaagagcctgattcatacccatcagaacccatctttgtttctcacccagatgccttggaagaagatgatggtgtagttctgagtgtggtggtgagcccaggagcaggacaaaagcctgcttatctcctgattctgaatgccaaggacttaagtgaagttgcccgggctgaagtggagattaacatccctgtcacctttcatggactgttcaaaaaatcttgagcatactccagcaagatatgtttttggtagcaaaactgagaaaatcagcttcaggtctgcaatcaaattctgttcaattttagcctgctatatgtcatggttttaacttgcagatgcgcacaattttgcaatgttttacagaaagcactgagttgagcaagcaattcctttatttaaaaaaaaaagtacgtatttagataatcatacttcctctgtgagacaggccataactgaaaaactcttaaatatttagcaatcaaataggaaatgaatgtggacttactaaatggcttttaattcctattataagagcatattttaggtacctatctgctccaattatatttttaacatttaaaaaccaaagtcctctacacttgatttatattatatgtggctttgctgagtcaaggaagtatcatgcaataaggcttaattactaaatgtcaaaccaaactttttctcaaaccagggactatcatctaagattaattacagtaattattttgcgtatacgtaactgctcaaagattatgaatcttatgaatgttaacctttccgtttattacaagcaagtactattatttctgattttataataagaaaatctgtgtttaatcaactgaggcctctcaaccaaataacatctcagagattaagttatatattaaaagcttatgtaacataaaagcaagtacatatagtagtgactatatttaaaaaaacagcataaaatgcttaaaaatgtaatatttactaaaatcagattatgggataatgttgcaggattatactttattgcatcttttttgtttaattgtatttaagcattgtgcaatcacttgggaaaaatattaaattattaacattgaggtattaatacattttaagccttttgtttttaaatttcttttcttccagagattgtttaaaaataaatattgacaaaaataa

SEQ ID NO: 175277 - DNA, 1810 bp, Homo sapiens
  Payload ID: 14426
  Gene Symbol: RLBP1
  Gene Name: retinaldehyde binding protein 1
  Uniprot ID: P12271
  ENST ID: ENST00000268125
  CDS Start-End: 441-1394
ggcctctcccctctcccctttctctctgggtcttcctttgccccactgagggcctcctgtgagcccgatttaacggaaactgtgggcggtgagaagttccttatgacacactaatcccaacctgctgaccggaccacgcctccagcggagggaacctctagagctccaggacattcaggtaccaggtagccccaaggaggagctgccgacctggcagggaacaaccaagactggggttaaatctcacagcctgcaagtggaagagaagaacttgaacccaggtccaacttttgcgccacagcaggctgcctcttggtcctgacaggaagtcacaacttggccctgacttcctatcctagggaaggggccggctggagaggccaggacagagaaagcagatcccttctttttccaaggactctgtgtcttccataggcaacatgtcagaaggggtgggcacgttccgcatggtacctgaagaggaacaggagctccgtgcccaactggagcagctcacaaccaaggaccatggacctgtctttggcccgtgcagccagctgccccgccacaccttgcagaaggccaaggatgagctgaacgagagagaggagacccgggaggaggcagtgcgagagctgcaggagatggtgcaggcgcaggcggcctcgggggaggagctggcggtggccgtggcggagagggtgcaagagaaggacagcggcttcttcctgcgcttcatccgcgcacggaagttcaacgtgggccgtgcctatgagctgctcagaggctatgtgaatttccggctgcagtaccctgagctctttgacagcctgtccccagaggctgtccgctgcaccattgaagctggctaccctggtgtcctctctagtcgggacaagtatggccgagtggtcatgctcttcaacattgagaactggcaaagtcaagaaatcacctttgatgagatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggattccttcccagcccggttcaaagccatccacttcatccaccagccatggtacttcaccacgacctacaatgtggtcaagcccttcttgaagagcaagctgcttgagagggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatgggtaataaaggagggggaattcccttgaacaagaagaactggggatagttatatttccacctgcccttgaagctttaagacagtgatttttgtgtaaggttgtatttcaaagactcgaattcattttctcagtcatttcctttgtaacagagttttacgacttagagtctgtgaaaacaggcaaggagcccgggttaaaatatccccctattcgcccccaaaatgcaataaaagaagataaaagagagagga

SEQ ID NO: 175278 - DNA, 609 bp, Homo sapiens
  Payload ID: 14426
  Gene Symbol: RLBP1
  Gene Name: retinaldehyde binding protein 1
  ENST ID: ENST00000563254
  CDS Start-End: 1-326
tcaatggcttctgcatcattgagaacttcaagggctttaccatgcagcaggctgctagtctccggacttcagatctcaggaagatggtggacatgctccagccatggtacttcaccacgacctacaatgtggtcaagcccttcttgaagagcaagctgcttgagagggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatgggtaataaaggagggggaattcccttgaacaagaagaactggggatagttatatttccacctgcccttgaagctttaagacagtgatttttgtgtaaggttgtatttcaaagactcgaa

SEQ ID NO: 175279 - DNA, 782 bp, Homo sapiens
  Payload ID: 14426
  Gene Symbol: RLBP1
  Gene Name: retinaldehyde binding protein 1
  ENST ID: ENST00000567787
  CDS Start-End: 245-460
gcctccagcggagggaacctctagagctccaggacattcaggtaccaggtagccccaaggaggagctgccgacctggcagggaacaaccaagactggggttaaatctcacagcctgcaagtggaagagaagaacttgaacccagccctgacttcctatcctagggaaggggccggctggagaggccaggacagagaaagcagatcccttctttttccaaggactctgtgtcttccataggcaacatgtcagaaggggtgggcacgttccgcatggtacctgaagaggaacaggagctccgtgcccaactggagcagctcacaaccaaggaccatggacctgtctttggcccgtgcagccagctgccccgccacaccttgcagaaggccaaggatgagctgaacgagagagaggagacccgggaggagcctgtccccagaggctgtccgctgcaccattgaagctggctaccctggtgtcctctctagtcgggacaagtatggccgagtggtcatgctcttcaacattgagaactggcaaagtcaagaaatcacctttgatgagatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggattccttcccagcccggttcaaagccatccacttcatccaccagccatggtacttcacc

SEQ ID NO: 175280 - DNA, 7100 bp, Homo sapiens
  Payload ID: 14427
  Gene Symbol: RP1
  Gene Name: retinitis pigmentosa 1 (autosomal dominant)
  Uniprot ID: P56715
  ENST ID: ENST00000220676
  CDS Start-End: 149-6619
gacatactgagaataaatccaaagacattagtttctttgcacgaaatgaggttacatatccagtgacatttatttgagctatttaaacaacttaaacatctttttcttttcttaataagggacgtttcaagttgtggtctcagccaaaatgagtgataccccttctactggtttttccatcattcatcctacgtcttctgaaggtcaagttccaccccctcgccatttgagcctcactcatcctgttgtggccaagcgaatcagtttctacaagagcggagacccccaattcggcggggtcagggtggtggtcaaccctcgctcctttaagtcctttgatgctctgctggataacttgtccaggaaggtgcccctcccttttggagtgaggaacatcagcacccctcggggcaggcacagcatcacgcgcctggaggagctggaggacggcgagtcctacctatgttcccacggcaggaaggtgcagcctgtagacctggacaaagcccgtcggcgcccgcggccctggctcagcagccgggccattagcgcgcactcaccgccccaccccgtagccgtcgctgctcccggcatgccccgccccccacggagcctagtggtcttcaggaatggcgacccgaagacgaggcgtgcggttcttctgagcaggagggtcacccagagcttcgaggcatttctacagcacctgacagaggtcatgcagcgccctgtggtcaagctgtacgctacggacggaaggagggttcccagcctccaggcagtgatcctgagctctggagctgtggtggcggcaggaagggagccatttaaaccaggaaattatgacatccaaaaatacttgcttcctgctagattaccagggatctctcagcgtgtgtaccccaagggaaatgcaaagtcagaaagcagaaagataagcacacatatgtcttcaagctcaaggtcccagatttattctgtttcttctgagaaaacacataataatgattgctacttagactattcttttgttcctgaaaagtacttggccttagaaaagaatgattctcagaatttaccaatatatccttctgaagatgatattgagaaatcaattatttttaatcaagacggcactatgacagttgagatgaaagttcgattcagaataaaagaggaagaaaccataaaatggacaactactgtcagtaaaactggtccttctaataatgatgaaaagagtgagatgagttttccaggaagaacagaaagtcgatcatctggtttaaagcttgcagcatgttcattctctgcagatgtgtcacctatggagcgaagcagtaatcaagagggcagtttggcagaggagataaacattcaaatgacagatcaagtggctgaaacttgcagttctgctagttgggagaatgctactgtggacacagatatcatccagggaactcaagaccaagcaaagcatcgtttttataggccccctacacctggactaagaagagtgagacaaaagaaatctgtgattggcagtgtgaccttagtatctgaaactgaggttcaagagaaaatgattggacagttttcatatagtgaagaaagggaaagtggggaaaacaagtctgagtatcacatgtttacacattcttgcagtaaaatgtcatcagtatctaacaaaccagtacttgttcagatcaataacaatgatcaaatggaggagtcatcattagaaagaaaaaaggaaaacagtctgcttaagtcaagtgcaataagtgctggtgttatagaaattacaagtcagaagatgttagagatgtcacataataatggtttgccatcaactatatcaaataactcaattgtggaggaagatgtagttgattgtgtggtattggacaacaaaactggtatcaagaacttcaaaacttatggtaacaccaatgataggttcagtcctatttcagcagatgcaacccatttttcaagtaataactctggaactgacaaaaatatttctgaggctccagcttcagaagcatcctctactgtcactgcaagaattgacagactaattaatgaatttgctcagtgtggtttaacaaaacttccaaaaaatgaaaagaagattttgtcatctgttgccagcaaaaagaagaaaaaatctcgacagcaagcaataaattccaggtatcaagatggacagcttgcaaccaaaggaattcttaataagaatgagagaataaacacaaaaggtagaattacaaaggaaatgatagtgcaagattcagatagtccccttaaaggagggatactttgtgaggaagacctccagaaaagtgatactgtaattgaatcaaatactttttgttccaaaagtaatctcaattccacgatttccaagaatttccatagaaataaattaaatactactcaaaattccaaggttcaaggacttttaaccaaaagaaaatctagatcactaaataaaataagcttaggagcacctaaaaaaagagaaatcggtcaaagagataaagtgtttcctcacaatgaatctaaatattgcaaaagtacttttgaaaacaaaagtttatttcatgtatttaacatccttgagcaaaaacccaaagatttttatgcaccgcaatctcaagcagaagtggcatctgggtatttgagaggaatggcaaagaagagtttagtttcaaaagttactgattcacacataactttaaaaagccagaaaaaacgtaaaggggataaagtgaaagcaagtgctattttaagtaaacaacatgctacaaccagggcaaattctttagcttctttgaaaaaacctgattttcctgaggctattgctcatcattcaattcaaaattatatacagagttggttgcagaacataaatccatatccaactttaaagcctataaaatcagctccagtatgtagaaatgaaacgagtgtggtaaattgtagcaataatagtttttcagggaatgatccccatacaaattctggaaaaataagtaattttgttatggaaagtaataagcacataactaaaattgccggtttgacaggagataatctatgtaaagagggagataagtcttttattgccaatgacactggtgaagaagatctccatgagacacaggttggatctctgaatgatgcttatttggttcccctgcatgaacactgtactttgtcacagtcagctattaatgatcataatactaaaagtcatatagctgctgaaaaatcaggaccagagaaaaaacttgtttaccaggaaataaacctagctagaaaaaggcaaagtgtagaggctgccattcaagtagatcctatagaagaggaaactccaaaagacctcttaccagtcctgatgcttcaccaattgcaagcttcagttcctggtattcacaagactcagaatggagttgttcaaatgccaggttcacttgcaggtgttccctttcattctgcaatatgtaattcatccactaatctccttctagcttggctcttggtgctaaacctaaagggaagtatgaatagcttctgtcaagttgatgctcacaaggctaccaacaaatcttcagaaacacttgcattgttggagattctaaagcacatagctatcacagaggaagctgatgacttgaaagctgctgttgccaatttagtggagtcaactacaagccactttggactcagtgagaaagaacaagacatggttccaatagatctttctgcaaattgttccacggtcaacattcagagtgttcctaagtgcagtgaaaatgaaagaacacaaggaatctcctctttggatggaggttgctctgccagtgaggcatgtgcccctgaagtctgtgttttggaagtgacttgctctccatgtgagatgtgcactgtaaataaggcttattctccaaaagagacatgtaaccccagtgacactttttttcctagtgatggttatggtgtggatcagacttctatgaataaggcttgtttcctaggagaggtctgttcacttactgatactgtgttttctgataaggcttgtgctcaaaaggagaaccatacctatgagggagcttgcccaattgatgagacctacgttcctgtcaatgtctgcaataccattgactttttaaactccaaagaaaacacatatactgataacttggattcaactgaagagttagaaagaggtgatgacattcagaaagatctaaatattttgacagaccctgaatataaaaatggatttaatacattggtgtcacatcaaaatgtcagtaatttaagctcctgtggcctttgcctaagtgaaaaagaagcagaacttgataagaaacatagttctctagatgattttgaaaattgttcactaaggaagtttcaggatgaaaatgcatatacttcctttgatatggaagaaccacggacttctgaagaaccaggctcaataaccaacagcatgacatcaagtgaaagaaacatttcagaattggaatcttttgaagaattagaaaaccatgacactgatatctttaatacagtggtaaatggaggagagcaagccactgaagaattaatccaagaagaggtagaggctagtaaaactttagaattgatagacatctctagtaagaatattatggaagaaaaaagaatgaacggtataatttatgaaataatcagtaagaggctggcaacaccaccatctttagatttttgctatgattctaagcaaaatagtgaaaaggagaccaatgaaggagaaactaagatggtaaaaatgatggtgaaaactatggaaactggaagttattcagagtcctctcctgatttaaaaaaatgcatcaaaagtccagtgacttctgattggtcagactatcggcctgacagtgacagtgagcagccatataaaacatccagtgatgatcccaatgacagtggcgaacttacccaagagaaagaatataacataggatttgttaaaagggcaatagaaaaactgtacggtaaagcagatattatcaaaccatctttttttcctgggtctacccgcaaatctcaggtttgtccttataattctgtggaatttcagtgttccaggaaagcaagtctttatgattctgaagggcagtcatttggctcttctgaacaggtatctagtagttcatctatgttgcaggaattccaggaggaaagacaagataagtgtgatgttagtgctgtgagggacaattattgtaggggtgacattgtagaacctggtacaaaacaaaatgatgatagcagaatcctcacagacatagaggaaggagtactgattgacaaaggcaaatggcttctgaaagaaaatcatttgctaaggatgtcatctgaaaatcctggcatgtgtggcaatgcagacaccacatcagtggacaccctacttgataataacagcagtgaggtaccatattcacattttggtaatttggccccaggcccaacgatggatgaactctcctcttcagaactcgaggaactgactcaaccccttgaactaaaatgcaattactttaacatgcctcatggtagtgactcagaaccttttcatgaggacttgctggatgttcgcaatgaaacctgtgccaaggaaagaatagcaaatcatcatacagaggagaagggtagtcatcagtcagaaagagtatgcacatctgtcactcattcctttatttctgctggtaacaaagtctaccctgtctctgatgatgctattaaaaaccaaccattgcctggcagtaatatgattcatggtacacttcaggaagctgactctttggataaactgtatgctctttgtggtcaacattgcccaatactaactgttattatccaacccatgaatgaggaagaccgaggatttgcatatcgcaaagaatctgatattgaaaatttcttgggtttttatttatggatgaaaatacacccatatttacttcagacagacaaaaatgtgttcagggaagagaacaataaagcaagtatgagacaaaatcttattgataatgccattggtgatatatttgatcagttttatttcagtaacacatttgacttgatgggtaaaagaagaaaacaaaaaagaattaacttcttggggttagaggaagaaggtaatttaaagaaatttcaaccagatttgaaggaaaggttttgtatgaatttcttgcacacatcattgttagttgtgggtaatgtggattcaaatacacaagacctcagcggtcagacaaatgaaatctttaaagcagtcgatgagaataacaacttattaaataacagattccagggctcaagaacaaatctcaaccaagtagtaagagaaaatatcaactgtcattacttctttgaaatgcttggtcaagcttgcctcttagatatttgccaagttgagacctccttaaatattagcaacagaaatattttagaactttgtatgtttgagggtgaaaatcttttcatttgggaagaggaagacatattaaatttaactgatcttgaaagcagtagagaacaagaagatttataatttcaatatcagcacactcattctttgtcaattcattttttcccatgagatgaagcacatgtgacgaatacggactagataacctctaagaattttccacttcttcaaaatgaacttactctagaaagcttacccttggataaccagtttgactttcataatgtctctgttttttgtttttccaacaattacagactcaggttctcttattttggaagtttctatctggttttgttctgaacttacattttttttttttttggtatctatgattttttttgctcagggcatcaaaatgtgctaaggacaagaattatatcctttttaaaaaatgttgttagcttggtgtaaaatgtatattgactgtattggtgaataaattgaatagacataacctcaaagtacttcacttattctttttaactactgatttgataaaaagtatgattataagatatccacgacaatctcatagtttctt

SEQ ID NO: 175281 - DNA, 7973 bp, Homo sapiens
  Payload ID: 14428
  Gene Symbol: RP1L1
  Gene Name: retinitis pigmentosa 1-like 1
  ENST ID: ENST00000382483
  CDS Start-End: 225-7427
gcccaagggactggggcctcaggctctcaggccaaggagagtggccccgaggactgtccggaggagggtggccagccctgctgcccagagggactgagccactggcagggaaggaggcggtgttccccctggcctgactttcctccaaaggacgtccccctgaggcttaggggctgagccatgcccttgtgctccctggaggacgcggccagagcccccacaccatgaacagcacccccaggaatgcccaggccccgagccaccgtgagtgcttcctgccctctgtggctcgcaccccctcggtcaccaaggtcacgccagccaagaagatcaccttcctcaagcgaggggatccacggtttgctggggtccgcctggccgttcaccagcgcgcctttaagaccttcagcgccctcatggacgagctctcccagcgcgtgcctctctcctttggggtgcgctctgtcaccacaccccggggcctgcatagcctcagcgccctggagcagctggaagatggaggctgctacctctgctctgataagaagccccccaagacccccagtggaccaggccggccacaggagagaaaccccactgctcagcagttgcgggatgtcgaaggccagcgtgaagccccaggcacctcctcctcccggaagagtcttaaaaccccccggaggatactgctgattaagaacatggaccctcgcctccagcagacagtggttctcagtcacaggaatactaggaacctggccgcctttctcggcaaagcctcagatctcctgcgctttcctgtgaagcagttgtacacgaccagcgggaaaaaggtggactcgctgcaggccctgctgcacagcccctctgtgctggtgtgtgccgggcatgaggccttcagaaccccagccatgaaaaatgccaggagaagcgaggctgaaactttatctgggctgacttcaagaaacaaaaacgggagctgggggccaaagaccaagccgagtgtgatccattcgcggtctccgccaggcagcacgccacggctgccagaaaggcctggtcctagcaaccccccggtgggccctgctcctggcaggcaccctcaggacacgccagctcagtcgggcccgctggtggctggcgatgacatgaagaagaaggtccgcatgaatgaggacggcagcctgtccgtggagatgaaagtccgcttccacctggtcggcgaggacacgctcctatggtcccggaggatgggcagggccagcgccctcacggcagccagtggggaagaccccgttctgggggaggtagaccccctctgctgtgtgtgggagggctacccttggggcttctcagagcctggggtgtggggaccccggccctgcagggtgggatgcagggaagtctttggccgaggcgggcagccagggcccaagtatgaaatctggacgaatcccctgcatgcctcccagggagagagagtggcagctcggaagaggtggggactggcccagcacgtccgctgcagtggcctgtggggccacgggactgccgggagggagagatgcagccaggacagtgccagcccagcctccagcaccggcctccccgagggctcggagccagagtcctcctgctgccccaggaccccggaggacggggtggacagtgccagcccctctgcccagataggggctgagcggaaagctggagggagcctgggtgaggaccccggcctatgcatagatggagcagggctgggcggcccagagcaaggcggccgcctgacaccgagggcccggagtgaggagggggcttcttcggactcgtcagccagcaccggctctcatgagggatccagcgaatggggtgggcggccccagggctgtccaggcaaggcaagggccgagacctctcagcaggaggccagcgagggaggcgaccccgcttctccagccctgagtctttcatctttaaggagtgacgacctgcaggcagagacgcaaggacagggcaccgagcaggccacgggagcggctgtgacaagggagcctctggttctgggcctttcctgctcctgggactcggaaggagcctcttccaccccttccacctgcacttcatcccagcaggggcagagaaggcacagaagccgggccagtgcaatgtcctcacccagcagccctggccttggccgagtggccccgagaggccatcccaggcattctcactaccgcaaggacacccacagcccactggactcctctgtaaccaagcaagtgccgaggcctcctgagcggcgaagggcctgccaggatggctcagtgccacgatattctggaagctcatcgagcaccaggacacaggcctctgggaacctgagacctccctcctcgggctctcttccttcccaggaccttctgggaaccagcagtgccactgtcacccctgcagtccactcggattttgtttctggagtctccccgcacaacgctccctctgccgggtgggcaggggacgcggggtccaggacatgctcgccggcccccatacctccccacacatccgactcctgctcaaaatctggggctgccagcctgggggaagaggccagggacacgcctcagccctcctcacccttggttctgcaggttggacggcctgagcaaggggcggtgggcccccaccgaagccactgctgctcacagcctgggacgcagccggcccaagaggcccagcggggaccctcccctgaggctagctggctgtgtggcaggtactgtcccaccccgcccagggggcggccctgcccccagaggcgctcttccagctgtgggagcaccggcagcagccaccaaagcactgcccgggggccaggtgggagcccgcaggaggggacacgccagccaggccccacgccgtccccaggccccaattcaggggcatcaaggagaagcagtgccagccagggtgcggggtctcgggggctgtccgaggagaagaccttgaggagtgggggaggcccccaggggcaggaggaggccagtggtgtgtcacccagctctctgccccgctcgtctccagaggctgtggtccgcgaatggctggacaacattccagaagagcccatactcatgacatatgagttggcggacgagaccacaggtgcagctgggggtggcctgagaggccccgaggtggaccctggggatgaccattctctggaaggcctgggggagccagctcaggcgggacagcagtccctggaaggggaccccggccaggacccagagccagagggagccctcctggggagtagtgacactggtccccaatcaggagagggtgtcccccaaggggcagctccagagggagtttccgaggcccctgcagaggccggagcagacagagaggccccagcaggctgcagggtgagcctgcgggcacttcctggccgggtgtctgcctccacgcagatcatgagggcgctgatgggctccaagcagggccggcccagcagcgtgcccgaagtgtctaggcccatggccaggaggctcagctgctcagccggggccctcattacttgtctggccagtctgcagttatttgaggaagaccttgggtctcctgccagcaaagtgaggttcaaagactcccctcggtaccaggagctgctcagcatctcgaaggacctgtggccaggatgtgacgttggggaagaccagctggactcaggcctctgggagctcacatggagccaggctctgccagaccttgggtcccatgccatgacggagaacttcacgcccacatcctcctctggtgtggacatcagcagcggctctggaggctcaggggagagtagcgtaccctgtgccatggacggcaccctggtgacacaggggacagagctgcccctgaaaacctccaaccagaggcctgattcaagaacttatgagagcccaggggatctggaaaaccaacagcagtgttgtttcccaaccttcttgaacgcccgagcctgcgcttgtgccaccaatgaggatgaagcagaaagagacagtgaggagcagagggcgagctcgaacctggagcagttagctgaaaacacagtgcaagaagaggtgcaattagaggaaactaaagaaggaacagaaggagaagggctgcaagaagaggcggtgcagttagaggaaactaaaacagaagaagggctgcaagaagagggggtgcagttagaggaaactaaagaaacagaaggagaaggacagcaagaagaagaggcgcagttagaggaaattgaagaaacaggaggagaagggctgcaagaagagggggtgcagttagaggaagttaaagaagggccagaaggaggactgcaaggagaggctcttgaagagggtctcaaagaggaaggacttccagaagaaggaagcgtccacgggcaggaattgtcagaggccagctctccggatgggaaaggctcccaggaagatgacccagtccaggaggaggaagcaggaagagcctctgcctctgcagagccgtgccccgcagagggcacagaggaacccacagagccccctagtcatctcagcgagacggacccaagtgccagcgagaggcagagtggctcccagcttgagcctggtttggaaaagccgcccggagccaccatgatgggccaagagcacacgcaggcccaacccacccagggggctgcagagaggagctcttcggtggcctgcagcgcggctctggactgcgaccccatctgggtgtccgtgttactgaagaagacggagaaggccttcctggcccaccttgccagtgcggtggctgagctccgagcacgctggggcctgcaggacaatgatctgctggaccagatggcggccgagctgcagcaggacgtggcccaacgcctccaggacagcaccaagagagagctccagaagctccagggccgggcgggtaggatggtgctggagcctccaagggaggccctcaccggggagctgctcctgcagacccagcagcgcagacaccgtctccggggcctgcgaaacctctcggccttctctgagcggaccctgggcctggggcccctctccttcaccctggaggacgagccagccctcagcacagccctggggagccagctgggcgaggaggcggagggggaggagttctgtccctgcgaggcctgcgtgaggaagaaagtgagccctatgtcccccaaggccacaatgggggcaaccagaggtcccatcaaagaggcctttgacctgcagcagattctgcagaggaagaggggagaacacactgatggggaggcagcagaggtggcccctggcaagacccacacggaccccacgagcactaggactgtccagggagctgagggagggctggggccggggctgagccaggggcctggagtggacgagggtgaggatggcgaggggagccagagactcaacagagacaaagatcccaaactcggggaggcagagggagatgcaatggctcaggagagagaagggaaaacccacaacagtgaaaccagtgcgggcagtgagttgggggaagctgagcaggagggagagggcataagtgaaaggggagaaactgggggtcaaggctctgggcatgaggacaacttgcagggtgaagctgcggcaggaggtgaccaagatccaggacagagtgatggggccgaaggcatagaggccccggaggctgaaggggaggcccagccagagtcagaaggtgtagaggccccagaggcagaaggggatgcccaggaggctgaaggggaggcccagccagagtcagaagatgtagaggccccagaggcagaaggagaggcccagccagagtcagaagatgtagagaccccagaggcagaatgggaggtccagccagagtcagaaggtgcagaagccccggaggcagaaaaggaggcccagccagagacagaaagtgtagaggccctggagactgaaggggaggacgagccagagtcagaaggtgcagaggcccaagaggcagaagaggcggcccaggaggcagaagggcagacccagccagagtcagaagttatagagtcccaggaggcagaagaggaagcccagccagagtcagaagatgtagaggccctggaggttgaagtggagacccaggaggcagaaggggaggcccagccagagtcagaagatgtagaggccccagaggctgaaggggagatgcaagaggcagaagaggaggcccagccagagtcagacggtgtagaggcccagccaaagtcagaaggtgaagaggcccaggaggttgaaggggagacccagaagacagaaggggatgcccagccagagtcagacggtgtagaggccccggaggcagaagaggaggcacaggaggctgaaggggaggtccaggaggcagaaggggaggcccacccagagtcagaagatgtagatgcccaggaggcagaaggggaggcccagccagaatcagaaggtgtagaggccccagaggcagaaggggaggcccagaaggcagaaggtatagaggccccagagactgaaggggaggcccagccagagtcagaaggtatagaggccccagaggctgaaggggaggcccagcctgagtcagaaggtgtagaggcccaggatgcagaaggggaggcccagccagagtcagaaggtatagaggcccaggaggctgaagaggaggcccaaccagagttagaaggtgtagaggccccagaggcagaaggggaggcccagccagagtcagaaggtatagaggccccagaggcagaaggggaggcccaaccagagttagaaggtgtagaggccccggaggctgaagaggaggcccagccagagccagaaggcgtagagaccccggaggctgaaggggaggcccagccagagtcagaaggagaaactcaaggtgagaaaaaggggagccctcaggtcagtctaggagatggccaatctgaggaggcttctgaaagcagcagcccagtccctgaggacaggcccactccacccccttccccaggtggagacactccccaccaaaggccaggctcccaaacaggcccttcctcctccagagcatcctcttggggcaactgctggcagaaagactcagaaaatgaccatgtacttggagacacaaggagccctgatgccaagtccacggggacccctcatgcagagaggaaggccaccaggatgtacccagaaagttctacttctgagcaagaagaggcccctttgggctcaaggactccagagcagggggccagtgaaggttatgacctacaagaggaccaggcactcggaagtctcgcccccactgaggcagtgggcagggcagacggctttggccaagatgacttagatttctagacaagatcaagctagaaaacaatcacgagcttgggagctctgtttttattcatattttttctacaaaactgagcaacgttcagtccactggagatgtccatagtacatggacaaagaccaaggacttgccaaggacacagcccatgccatgctgtcctgggactcttaagtccagaagtgtcagagagctctgcggcccgtcccacacgcagtgtgaagaaagggggtgtctgcggatctgcccggttatcggaggtcagcccggctcctatttatttgtctgcagagcccgaaagatggaactgattggaaaggctccagtttagcttttgtttgtgggtttgttttctgctagcaagtgttgctctctgtcttttccctgttgatctcctgttacttttctccttggcttctgttggcactcacctcatttgactttgaggtgctttttttctagtcttgaatatatttgatgactctgcagaaatacttgggcaaagcaggtaacttcagagtcattggataaagtttgttctcaactccaaa

SEQ ID NO: 175282 - DNA, 3803 bp, Homo sapiens
  Payload ID: 14429
  Gene Symbol: RP2
  Gene Name: retinitis pigmentosa 2 (X-linked recessive)
  Uniprot ID: O75695
  ENST ID: ENST00000218340
  CDS Start-End: 162-1214
ggggtgctgggcctggcgggcaaactaaggctgcggaccgttgggcggttccgcggggcgttgtccggagagctgcgaggccggggttcccagggttcacgccacactctaggaagtgcctgagctagtgagctggccaacgagctccgcgggctgggaccatgggctgcttcttctccaagagacggaaggctgacaaggagtcgcggcccgagaacgaggaggagcggccaaagcagtacagctgggatcagcgcgagaaggttgatccaaaagactacatgttcagtggactgaaggatgaaacagtaggtcgcttacctgggacggtagcaggacaacagtttctcattcaagactgtgagaactgtaacatctatatttttgatcactctgctacagttaccattgatgactgtactaactgcataatttttctgggacccgtgaaaggcagcgtgtttttccggaattgcagagattgcaagtgcacattagcctgccaacaatttcgtgtgcgagattgtagaaagctggaagtctttttgtgttgtgccactcaacccatcattgagtcttcctcaaatatcaaatttggatgttttcaatggtactatcctgaattagctttccagttcaaagatgcagggctaagtatcttcaacaatacatggagtaacattcatgactttacacctgtgtcaggagaactcaactggagccttcttccagaagatgctgtggttcaggactatgttcctatacctactaccgaagagctcaaagctgttcgtgtttccacagaagccaatagaagcattgttccaatatcccggggtcagagacagaagagcagcgatgaatcatgcttagtggtattatttgctggtgattacactattgcaaatgccagaaaactaattgatgagatggttggtaaaggctttttcctagttcagacaaaggaagtgtccatgaaagctgaggatgctcaaagggtttttcgggaaaaagcacctgacttccttcctcttctgaacaaaggtcctgttattgccttggagtttaatggggatggtgctgtagaagtatgtcaacttattgtaaacgagatattcaatgggaccaagatgtttgtatctgaaagcaaggagacggcatctggagatgtagacagcttctacaactttgctgatatacagatgggaatatgaagtgcaatgtggaaccaggacttggtattaagcctttcccaacttgtgaatatagaatttgataatacacttttgtgtattagcaatggtttttactaatgctaaaacttttaaagtttattttttaataaattgttgagtattacatcatttacttgaggttcaaaaataattcattttaaattaagtagttttaatcagcttaaaagctatttaacccattttaataagcttgcagttttgtttctctgcatatgatattcttattagaaaacagaagtagctaaaagtttattattttaatcctatttaaatgttctttcaaatctctaataatttaaactttcctcagtgctccatgatactttttttgagactccatatcattgcttattttacctttttcaatttagagggatttgttactagtcgatcaattagaatgaacctatgcacatttttatgtacacatatccagttatataattgcttcctagttgcattatatggcaaatgagattttgtacatggagttgacataatactttgtaaattgaattttttaaagaaataggcatttgataaccagcttggcaagtaactctactaacagatgttggtatagctatttaaagactacttcgtaagtagtatgattatttgaataaattacacattgtttagttttttaatacaactgctatatgactcttctgcttcctgataagaaaaggtatatgcaatgctaaaactgtagaagcccaatcaccagcagtttttaaaaaggtgataacttttattagctcttgtgggctatcaagagaattggaacaaaaccttgtgacttttaggtaagaaataggcatgatgataagctatgcagattattaaaaagcttgatacatttgatttttcattagatatgccattcatatcaagtaatgttcaagtatgataaaattattttggttgctttaaagcactgtttcccaaatctacctgatcataataatttaccaggaagcagaggagagctacttgtttaaaaatccacattcttggacccaatcctcagatgcacggattcagtcttcaggggaaactctgttttaaggggtatgttgtaatctaaagtaattggttcaggaggtgtcaataggttgaacttgtgagaaggcactgaatctgccatccacatcacatatagcagctattatgaaatcagctttcataggcctatttttaaaaggaatctgaaatttaattctattttgataaaactaagactgaaaataaccacttgtaaacattcctatgattgttactaaaatgtattttcatgtttaaaatgtttttggatatttttgggttaataactactacattgaattgcatgttaaggtgcagaaataatacattaaaagattttcactttaaattaattagtaatattgagcgctcaccctgtgcgtggccttgtgctaaccattagcactgcatcatttcaattcttttataagggcattcaatactacaaaatcaacatgatttcataaggtgcaaataaaagttggtgacagatttaatataattttgatcacaatttacaaatgatctttgcaaatagtggtcagacggcattagtttttcccttagttaagctaaattaaagggactccatcctgttatgattatattattattattattattattatttttgaggtggagtttcactcttgttgcccaagctggagtgcaatggcgcgatctcggctcaccacaacatccgcctcctgggttcaagcgattctcctgcctcagcctcctgagtagctgggaatacaggcatgcgccactacacctggctaatttttgtatttttagttgagatggggtttttccacgttggtcaggctggtctcgaactcctgacctcaggtgatccgtccacctcagcctcccaaagagctgggattacaggtgtgagctaccgcgcctggccatgatgatattattaaacaccattattcacatttcaaataataacaatactttttgtttttcaaaaataaaatgcaatgttatataaagctataaactaagttctttatgatatttgagcaacaactcaggaatataacatataagggagatgttaatttaaaaatttccactacacttattatctattaaccaaagcttaaaattttgtattcttctgttagataagaccttttacccatttaatttgtctttaaggacagtcatttggcttctgaatgtttgaaacgattttaaaaaataagtagtgctatggttgtttctataattctaacctttgatagtaatcagaatgtattacatttcatttctgaatagcttttgaatttatgaaaaattattaacaatgaaaaattggtaattttattaagttatatgtgtttaaatattatattagcttatttctcttgcattaatagtactgctgtttttgttttgcttctttatatttatgtctagcttttatatgtaatttatctagtgtttataaaatgtgatttgtaataaatgttgttaaaatgaaaa

SEQ ID NO: 175283 - DNA, 1121 bp, Homo sapiens
  Payload ID: 14430
  Gene Symbol: RP9
  Gene Name: retinitis pigmentosa 9 (autosomal dominant)
  Uniprot ID: Q8TA86
  ENST ID: ENST00000297157
  CDS Start-End: 19-684
ggcgctgcgggggctgacatgtcgtcccggcctgggcgcgaggacgtgggggctgcgggcgcgcggcggccgcgtgagccgccggagcaggagctgcagcgacgtcgggagcagaagcggcggcgacacgacgcgcagcagctgcagcagctcaagcacctggagtccttttacgaaaaacctcctcctgggcttatcaaggaagatgagactaagccagaagattgcataccagatgtaccaggcaatgaacacgccagggaatttctggctcatgcaccaactaaaggactttggatgccactggggaaagaagtcaaagttatgcagtgttggcgttgcaaacgctatggtcaccgaacgggtgacaaagaatgccctttctttatcaaaggcaaccaaaagttagagcagttcagagtggcacatgaagatcccatgtatgacatcatacgagacaataaacgacatgaaaaggacgtaaggatacagcagttaaaacagttactggaggattctacctcagatgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagcagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattcctttgaagtgtctcccacagggtggcaggactgggagaatctctgaggcgtgtcttccaggccctcccacagcttgtgccctccacagtgtggactcaggtcccatagacatcaggctggagtcttctctgttgttgagaataataaaagctcattatttattttttaaa

SEQ ID NO: 175284 - DNA, 629 bp, Homo sapiens
  Payload ID: 14430
  Gene Symbol: RP9
  Gene Name: retinitis pigmentosa 9 (autosomal dominant)
  ENST ID: ENST00000448915
  CDS Start-End: 131-629
aacacctcgccttcagaatttccttcccatcttgctgcctgtcccatctggagacttgcgtgctcagcattctgggtctcctctgggttcagtccctggatggaaataaggaaggcctggccagtcttagatggcaggtgccgctcagcacagggaggagaagcattctgctcttctcagttacgaaaaacctcctcctgggcttatcaaggaagatgagactaagccagaagattgcataccagatgtaccaggcaatgaacacgccagggaatttctggctcatgcaccaactaaaggactttggatgccactggggaaagaagtcaaagttatgcagtgttggcgttgcaaacgctatggtcaccgaacgggtgacaaagaatgccctttctttatcaaaggcaaccaaaagttagagcagttcagagtggcacatgaagatcccatgtatgacatcatacgagacaataaacgacatgaaaaggacgtaaggatacagcagttaaaacagttactggaggattctacctcagatgaagataggagcagctccagttcctctgaaggtaaagagaaacacaagaaaaagaagaagaaagaaaagcataagaaaaggaagaaagaaa

SEQ ID NO: 175285 - DNA, 3108 bp, Homo sapiens
  Payload ID: 14431
  Gene Symbol: RPGR
  Gene Name: retinitis pigmentosa GTPase regulator
  Uniprot ID: Q92834
  ENST ID: ENST00000318842
  CDS Start-End: 198-2645
aagctccgcccccgttgcccgtagcggctgtttgttgacttccgggagcgcggttgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaaattgaaataagatatttcctagtttttactaaacaattttacttctttataattttataaggcaatatttgcaatcttacgacactgtaacagtttttgatgtatttacaatttttacaaaactgaggtaaaattgtttataatgaacatattttaataaactatatctggtcagttccactgttaa

SEQ ID NO: 175286 - DNA, 3686 bp, Homo sapiens
  Payload ID: 14431
  Gene Symbol: RPGR
  Gene Name: retinitis pigmentosa GTPase regulator
  Uniprot ID: Q92834
  ENST ID: ENST00000339363
  CDS Start-End: 169-3231
gtttgttgacttccgggagcgcggttgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtaggtaatgacacaggccaggtgggacctcaggctgacactgatggagagggtttacaaaaagaggtatatagacatgaaaataataatggtgttgatcaacttgatgctaaggaaatagaaaaggaaagtgatggaggacacagtcagaaggaatcagaagcagaagaaatagacagtgagaaggaaactaaactggcagaaatagcaggtatgaaggatttaagagaaagggaaaagagtacaaaaaagatgagtcctttctttggcaacttaccagatagaggtatgaatactgagagtgaagaaaataaagattttgttaagaaaagggaaagttgcaagcaagatgtgatctttgacagtgaaagagaatcagtagaaaagccagacagttacatggaaggtgcaagtgagagtcaacagggtatagctgatggattccagcagcctgaggcaatagaatttagtagtggagagaaagaggatgatgaagtggaaactgaccaaaacatacggtatggcaggaaattgattgaacaaggaaatgaaaaagagactaaacccataatatccaaatccatggcaaagtatgattttaaatgtgatcgcttgtcagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaaattgaaataagatatttcctagtttttactaaacaattttacttctttataattttataaggcaatatttgcaatcttacgacactgtaacagtttttgatgtatttacaatttttacaaaactgaggtaaaattgtttataatgaacatattttaataaactatatctggtcagttcc

SEQ ID NO: 175287 - DNA, 4767 bp, Homo sapiens
  Payload ID: 14431
  Gene Symbol: RPGR
  Gene Name: retinitis pigmentosa GTPase regulator
  Uniprot ID: Q92834
  ENST ID: ENST00000378505
  CDS Start-End: 178-3636
gtagcggctgtttgttgacttccgggagcgcggttgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggtgagtgaaggcaaggcaaaatcagtgggagaagcagaggatgggcctgaaggtagaggggatggaacctgtgaggaaggtagttcaggagcagaacactggcaagatgaggagagggagaagggggagaaagacaagggtagaggagaaatggagaggccaggagagggagagaaggaactagcagagaaggaagaatggaagaagagggatggggaagagcaggagcaaaaggagagggagcagggccatcagaaggaaagaaaccaagagatggaggagggaggggaggaggagcatggagaaggagaagaagaggagggagacagagaagaggaagaagagaaggagggagaagggaaagaggaaggagaaggggaagaagtggagggagaacgtgaaaaggaggaaggagagaggaaaaaggaggaaagagcggggaaggaggagaaaggagaggaagaaggagaccaaggagagggggaagaggaggaaacagaggggagaggggaggaaaaagaggagggaggggaagtagagggaggggaagtagaggaggggaaaggagagagggaagaggaagaggaggagggtgagggggaagaggaggaaggggagggggaagaggaggaaggggagggggaagaggaggaaggagaagggaaaggggaggaagaaggggaagaaggagaaggggaggaagaaggggaggaaggagaaggggagggggaagaggaggaaggagaaggggagggagaagaggaaggagaaggggagggagaagaggaggaaggagaaggggagggagaagaggaaggagaaggggagggagaagaggaggaaggagaagggaaaggggaggaggaaggagaggaaggagaaggggagggggaagaggaggaaggagaaggggaaggggaggatggagaaggggagggggaagaggaggaaggagaatgggagggggaagaggaggaaggagaaggggagggggaagaggaaggagaaggggaaggggaggaaggagaaggggagggggaagaggaggaaggagaaggggagggggaagaggaggaaggggaagaagaaggggaggaagaaggagagggagaggaagaaggggagggagaaggggaggaagaagaggaaggggaagtggaaggggaggtggaaggggaggaaggagagggggaaggagaggaagaggaaggagaggaggaaggagaagaaagggaaaaggagggggaaggagaagaaaacaggaggaacagagaagaggaggaggaagaagaggggaagtatcaggagacaggcgaagaagagaatgaaaggcaggatggagaggagtacaaaaaagtgagcaaaataaaaggatctgtgaaatatggcaaacataaaacatatcaaaaaaagtcagttactaacacacagggaaatgggaaagagcagaggtccaaaatgccagtccagtcaaaacgacttttaaaaaacgggccatcaggttccaaaaagttctggaataatgtattaccacattacttggaattgaagtaacaaaccttaaatgtgacccgattatggccagtcagacaatttaaatgccttgcatataacgggcactcattacgtgttattaaattgattttatgtcaattattttatgtgtagtaaaaaaaaaagcaactgatgcagctgtgttaaggagccaaagacaataggaggcactggtaaattttggcctctctcaaactaaaattttcgtgtatttcccccccaaattataaaaacataactagaaaatattaaaaggtcatatcagattattaacattatatattcattaaaggcagctttaggaaacaggaatatactacaagagtgttttgtttgtgtatacaaatcattccatttttaaatggcacagatgcttaagggctataaaaacttctaatttcttataaatatgttagcactttttttaagttagtgattacagtttacctactgtatagaataattttctaataatggatggtattctaaaactcaattgaggcattcacattttaaagaaagtattgtctttcaccttttatgtgttctttttgcaaaaatctacaaagtgacagctgtgttcagagcttagatcccaaaaacgtgatctcttttagttactatctgggcagatggtagtatatctaatgaaatggtgattaatttaaatgtataatctggaaatatgtaaaacttgaagtattttttgtccaggcaaaggtactcattgggcctcagtttcttcatctctaaaatggagtggatgagatgatgtgataactgcagtcccttctaactcttaaattcttttcattctcacagattcactctatcattattgttattcatgtaagaaacgttttagggagaaaaattacactttaaaattaatttagttttctatacagttgttttctttactcttgaaaagttatgacagctttaacgtctcttgtcttctgtaattttttatttctaaactcctatcatttccaagctttaactgtactttatcagagccttcatttctggtatgtgttatatgccctcaatgtattcactgactgttctgtaatttcagtttgtctgttccttgtcagaatgtttcaagtaaaataaaaaattaaatgt

SEQ ID NO: 175288 - DNA, 426 bp, Homo sapiens
  Payload ID: 14431
  Gene Symbol: RPGR
  Gene Name: retinitis pigmentosa GTPase regulator
  ENST ID: ENST00000494707
  CDS Start-End: 1-426
gaccaaagaagcagagatagataattcttcaactgtagaaagccttggagaaactactgatatcttaaacatgacacacatcatgagcctgaattccaatgaaaagtcattaaaattatcaccagttcagaaacaaaaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcct

SEQ ID NO: 175289 - DNA, 428 bp, Homo sapiens
  Payload ID: 14431
  Gene Symbol: RPGR
  Gene Name: retinitis pigmentosa GTPase regulator
  ENST ID: ENST00000464437
  CDS Start-End: 1-389
atatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagaggttaagcctcatgagcagtgggagcttatatactataaacaatgaaatgggaaaacaaaggaataaggacttcaattagagagaggaaatattctctcaattaaatttagagattttc

SEQ ID NO: 175290 - DNA, 2268 bp, Homo sapiens
  Payload ID: 14431
  Gene Symbol: RPGR
  Gene Name: retinitis pigmentosa GTPase regulator
  Uniprot ID: Q92834
  ENST ID: ENST00000474584
  CDS Start-End: 140-1582
gttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagacacacatcatgagcctgaattccaatgaaaagtcattaaaattatcaccagttcagaaacaaaaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataa

SEQ ID NO: 175291 - DNA, 2819 bp, Homo sapiens
  Payload ID: 14431
  Gene Symbol: RPGR
  Gene Name: retinitis pigmentosa GTPase regulator
  Uniprot ID: Q92834
  ENST ID: ENST00000482855
  CDS Start-End: 56-1996
aaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagagtattctgccagtcactcccaaattgtttcagtttaaaaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaaa

SEQ ID NO: 175292 - DNA, 2004 bp, Homo sapiens
  Payload ID: 14432
  Gene Symbol: RPGRIP1
  Gene Name: retinitis pigmentosa GTPase regulator interacting protein 1
  Uniprot ID: Q96KN7
  ENST ID: ENST00000382933
  CDS Start-End: 81-1919
agttggtaaatgacagttatgaataaagcaagggcagaaaaaaacatgtaggggagagaatgaggaactaggtccaggagatgctgaaactggataataaagacgtcatatcacaccccttggggtatccatctgagagcttgctttccattgccagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatgaa

SEQ ID NO: 175293 - DNA, 3940 bp, Homo sapiens
  Payload ID: 14432
  Gene Symbol: RPGRIP1
  Gene Name: retinitis pigmentosa GTPase regulator interacting protein 1
  Uniprot ID: Q96KN7
  ENST ID: ENST00000400017
  CDS Start-End: 1-3861
atgtcacatctggtggaccctacatcaggagacttgccagttagagacatagatgctatacctctggtgctaccagcctcaaaaggtaagaatatgaaaactcaaccacccttgagcaggatgaaccgggaggaattggaggacagtttctttcgacttcgcgaagatcacatgttggtgaaggagctttcttggaagcaacaggatgagatcaaaaggctgaggaccaccttgctgcggttgaccgctgctggccgggacctgcgggtcgcggaggaggcggcgccgctctcggagaccgcaaggcgcgggcagaaggcgggatggcggcagcgcctctccatgcaccagcgcccccagatgcaccgactgcaagggcatttccactgcgtcggccctgccagcccccgccgcgcccagcctcgcgtccaagtgggacacagacagctccacacagccggtgcaccggtgccggagaaacccaagagggggccaagggacaggctgagctacacagcccctccatcgtttaaggagcatgcgacaaatgaaaacagaggtgaagtagccagtaaacccagtgaacttgtttctggttctaacagcataatttctttcagcagtgtcataagtatggctaaacccattggtctatgcatgcctaacagtgcccacatcatggccagcaataccatgcaagtggaagagccacccaagtctcctgagaaaatgtggcctaaagatgaaaattttgaacagagaagctcattggagtgtgctcagaaggctgcagagcttcgagcttccattaaagagaaggtagagctgattcgacttaagaagctcttacatgaaagaaatgcttcattggttatgacaaaagcacaattaacagaagttcaagaggcatacgaaaccttgctccagaagaatcagggaatcctgagtgcagcccatgaggccctcctcaagcaagtgaatgagctcagggcagagctgaaggaagaaagcaagaaggctgtgagcttgaagagccaactggaagatgtgtctatcttgcagatgactctgaaggagtttcaggagagagttgaagatttggaaaaagaacgaaaattgctgaatgacaattatgacaaactcttagaaagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctgaacagctcaaagatgttgcttatggcacccgaccgttgtcgttatgtttggaaacactgccagcccatggagatgaggataaagtggatatttctctgctgcatcagggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataa

SEQ ID NO: 175294 - DNA, 429 bp, Homo sapiens
  Payload ID: 14432
  Gene Symbol: RPGRIP1
  Gene Name: retinitis pigmentosa GTPase regulator interacting protein 1
  ENST ID: ENST00000554303
  CDS Start-End: 1-429
ctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaagaacagctcaaagatgttgcttatggcacccgaccgttgtcgttatgtttggaaacactgccagcccatggagatgaggataaagtggatatttctctgctgcatcagggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccag

SEQ ID NO: 175295 - DNA, 2955 bp, Homo sapiens
  Payload ID: 14432
  Gene Symbol: RPGRIP1
  Gene Name: retinitis pigmentosa GTPase regulator interacting protein 1
  ENST ID: ENST00000556336
  CDS Start-End: 39-2870
tgtcctctgggatctcttacagcttgggaacagagatcatgtcacatctggtggaccctacatcaggagacttgccagttagagacatagatgctatacctctggtgctaccagcctcaaaaggtaagaatatgaaaactcaaccacccttgagcaggatgaaccgggaggaattggaggacagtttctttcgacttcgcgaagatcacatgttggtgaaggagctttcttggaagcaacaggatgagatcaaaaggctgaggaccaccttgctgcggttgaccgctgctggccgggacctgcgggtcgcggaggaggcggcgccgctctcggagaccgcaaggcgcgggcagaaggcgggatggcggcagcgcctctccatgcaccagcgcccccagatgcaccgactgcaagggcatttccactgcgtcggccctgccagcccccgccgcgcccagcctcgcgtccaagtgggacacagacagctccacacagccggtgcaccggtgccggagaaacccaagagggggccaagggacaggctgagctacacagcccctccatcgtttaaggagcatgcgacaaatgaaaacagaggtgaagtagccagtaaacccagtgaacttgcccacatcatggccagcaataccatgcaagtggaagagccacccaagtctcctgagaaaatgtggcctaaagatgaaaattttgaacagagaagctcattggagtgtgctcagaaggctgcagagcttcgagcttccattaaagagaaggtagagctgattcgacttaagaagctcttacatgaaagaaatgcttcattggttatgacaaaagcacaattaacagaagttcaagaggcatacgaaaccttgctccagaagaatcagggaatcctgagtgcagcccatgaggccctcctcaagcaagtgaatgagctcagggcagagctgaaggaagaaagcaagaaggctgtgagcttgaagagccaactggaagatgtgtctatcttgcagatgactctgaaggagtttcaggagagagttgaagatttggaaaaagaacgaaaattgctgaatgacaattatgacaaactcttagaaagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatgaa

SEQ ID NO: 175296 - DNA, 2373 bp, Homo sapiens
  Payload ID: 14432
  Gene Symbol: RPGRIP1
  Gene Name: retinitis pigmentosa GTPase regulator interacting protein 1
  ENST ID: ENST00000555322
  CDS Start-End: 1-80
gggacatgcttattctgcagcgcaaaatcaacgtgtgttatcaggtgcaaggaaagatggtacaggaaggggatggataacaggaacgtgggaaccactcacaggactgggaatgaagcaagacctaagtttccagggctgataccaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctgggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatgaa

SEQ ID NO: 175297 - DNA, 2139 bp, Homo sapiens
  Payload ID: 14432
  Gene Symbol: RPGRIP1
  Gene Name: retinitis pigmentosa GTPase regulator interacting protein 1
  ENST ID: ENST00000555489
  CDS Start-End: 1-180
gagaggttgactcgactactagacctcaagaataaccgtatcaagcagctggaagaaagagctccctaccctttaacggataggcagctttctttcccctctagaacagctcaaagatgttgcttatggcacccgaccgttgtcgttatgtttggaaacactgccagcccatggagatgaggataaagtggatatttctctgctgcatcaggcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatgaa

SEQ ID NO: 175298 - DNA, 3870 bp, Homo sapiens
  Payload ID: 14432
  Gene Symbol: RPGRIP1
  Gene Name: retinitis pigmentosa GTPase regulator interacting protein 1
  ENST ID: ENST00000557771
  CDS Start-End: 39-3785
tgtcctctgggatctcttacagcttgggaacagagatcatgtcacatctggtggaccctacatcaggagacttgccagttagagacatagatgctatacctctggtgctaccagcctcaaaaggtaagaatatgaaaactcaaccacccttgagcaggatgaaccgggaggaattggaggacagtttctttcgacttcgcgaagatcacatgttggtgaaggagctttcttggaagcaacaggatgagatcaaaaggctgaggaccaccttgctgcggttgaccgctgctggccgggacctgcgggtcgcggaggaggcggcgccgctctcggagaccgcaaggcgcgggcagaaggcgggatggcggcagcgcctctccatgcaccagcgcccccagatgcaccgactgcaagggcatttccactgcgtcggccctgccagcccccgccgcgcccagcctcgcgtccaagtgggacacagacagctccacacagccggtgcaccggtgccggagaaacccaagagggggccaagggacaggctgagctacacagcccctccatcgtttaaggagcatgcgacaaatgaaaacagaggtgaagtagccagtaaacccagtgaacttgcccacatcatggccagcaataccatgcaagtggaagagccacccaagtctcctgagaaaatgtggcctaaagatgaaaattttgaacagagaagctcattggagtgtgctcagaaggctgcagagcttcgagcttccattaaagagaaggtagagctgattcgacttaagaagctcttacatgaaagaaatgcttcattggttatgacaaaagcacaattaacagaagttcaagaggcatacgaaaccttgctccagaagaatcagggaatcctgagtgcagcccatgaggccctcctcaagcaagtgaatgagctcagggcagagctgaaggaagaaagcaagaaggctgtgagcttgaagagccaactggaagatgtgtctatcttgcagatgactctgaaggagtttcaggagagagttgaagatttggaaaaagaacgaaaattgctgaatgacaattatgacaaactcttagaaagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaagaacagctcaaagatgttgcttatggcacccgaccgttgtcgttatgtttggaaacactgccagcccatggagatgaggataaagtggatatttctctgctgcatcagggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatgaa

SEQ ID NO: 175299 - DNA, 2371 bp, Homo sapiens
  Payload ID: 14432
  Gene Symbol: RPGRIP1
  Gene Name: retinitis pigmentosa GTPase regulator interacting protein 1
  ENST ID: ENST00000555587
  CDS Start-End: 1-2286
atgcttattctgcagcgcaaaatcaacgtgtgttatcaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctgaacagctcaaagatgttgcttatggcacccgaccgttgtcgttatgtttggaaacactgccagcccatggagatgaggataaagtggatatttctctgctgcatcagggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatgaa

SEQ ID NO: 175300 - DNA, 402 bp, Homo sapiens
  Payload ID: 14432
  Gene Symbol: RPGRIP1
  Gene Name: retinitis pigmentosa GTPase regulator interacting protein 1
  ENST ID: ENST00000557606
  CDS Start-End: 1-402
ttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgcagacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacag

SEQ ID NO: 175301 - DNA, 566 bp, Homo sapiens
  Payload ID: 14432
  Gene Symbol: RPGRIP1
  Gene Name: retinitis pigmentosa GTPase regulator interacting protein 1
  ENST ID: ENST00000557351
  CDS Start-End: 67-566
agttatgaataaagcaagggcagaaaaaaacatgtaggggagagaatgaggaactaggtccaggagatgctgaaactggataataaagacgtcatatcacaccccttggggtatccatctgagagcttgctttccattgccagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaaggtggagtttcgctcttgttgctcaggctcgagtgcaatggcacgatttcagctcactgcaaccttcacctcccagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaa

SEQ ID NO: 175302 - DNA, 4840 bp, Homo sapiens
  Payload ID: 14433
  Gene Symbol: RB1
  Gene Name: retinoblastoma 1
  Uniprot ID: P06400
  ENST ID: ENST00000267163
  CDS Start-End: 139-2925
tccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctcccctcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaatggtctgatgttgtgttctttgtattaagtacactaatgttctcttttctgtctaggagaagatagatagaagataactctcctagtatctcatcc

SEQ ID NO: 175303 - DNA, 480 bp, Homo sapiens
  Payload ID: 14433
  Gene Symbol: RB1
  Gene Name: retinoblastoma 1
  ENST ID: ENST00000467505
  CDS Start-End: 139-300
tccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatac

SEQ ID NO: 175304 - DNA, 1417 bp, Homo sapiens
  Payload ID: 14434
  Gene Symbol: RBBP4
  Gene Name: retinoblastoma binding protein 4
  Uniprot ID: Q09028
  ENST ID: ENST00000373485
  CDS Start-End: 74-1306
agcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggagttagtccttgaccactagtttgatgccatctccattttgggtgacctgtttcaccagcaggcctgttactctccatgactaactgtgtaagtgcttaaaatggaataaattgcttttctacataacccc

SEQ ID NO: 175305 - DNA, 7943 bp, Homo sapiens
  Payload ID: 14434
  Gene Symbol: RBBP4
  Gene Name: retinoblastoma binding protein 4
  Uniprot ID: Q09028
  ENST ID: ENST00000373493
  CDS Start-End: 160-1437
gctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcatatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataaccccatgctgatgggttttatttagtataaaacatccatcaaacaccagtctctggcttctagaagagtccttcagatgacagttgttgtccatggtctttgactatcaagagcagaattaaatgtaatagtcccagagctgtagaaaagaactttactccttcccagggaaagtgaaagacataaaacactgaatcagaggtggcacagattagtctttgataaggtaacgtttctttgaagtctatctgtagagaactacatggacttccaagagtgtcaaaggcagtgtggtagagagaatttaaggcaagatttaaatttggaaaaggtgcttgaaccttttctcagaggttttatttccccagtatgtttttcactggggcctttacttaggttagaaataataggctttgaaggcctctatcaccagatgcaataaccagataaaattcctgttttttcccaatcgcttagttttttgttgttgttgttttttaactgagtagatcattctgacccagaactactttcatgaggtaagatctttgggaaaatctgaatagcgttaaccattagattcaaatctcaaatggtttcttttcaagtctagttgttttagagtatagtgagaaataccttgacacaattttaagagtaaactatatgggtcagcatatccttgaacaaaaagtagactttgtaaaagtattcatttaaattctaacactcgtggcacaaaagaatggaaattgtaaacccatgtaatggaaattggctatctttttgaccccacatgtgcccctcaaaaatgtttttggtttgggtcaacacaaggcaagatacattctttaaaatactcccagatgtgtccatacattcatccttcactcagtgcatatgtgagggttgttgctggaagacaggaggctcatctttcctttccttggtgcattgagatcagtatcaacagcagatgaaatagaatccagcaaagagttgacatgttctgcctccggccaactctagaatctttttaagcaggtcagccagtatttgcaacttccacaggatgaattgcttgccaagtttctggcactcttgtctggttggaagagtacatccaaagggtacttagtgatcctttgctaagaagttttttgctgtttccgggttacagatttggccatatatttctaaacagcccctgtaaagttgaaagaaaaagtttataacagtgaacttctgaggtttagttactgcaggctttgttgagaagagattgttacagtgtgatttatggatgatcagggatgactttcccctagcaaatatttggatgcctcctgtttgtcaaatagaatgaatggtgatggtgatgggagggatagttaaacgttttctctgctaggttaacttcttacaggtataattacaatgcctgaaattctgtagtttcatttctttggattagtcgttgtcttttccagattgtacacaatctgatcaacacaaaggtagttagtagatcattaacctcaattgcaaggttataatttctcaaacattaagcatattatcagtcatgtggattcaaacacagtataagaaaatcctcaaggctgggtgtgatggcttatgcctgtaatcccagctacttagcaggctgaggcaggagtattgtttgaacccaggaggcagagttgcagtgagccaagatcgtgccactactccagcctgggcaaaatagcaagacccgaccccccatctctactaaaaagaaatttaaaaaaataaaatcctagaaaattagaaaaagcaacaatagttacttgtgggccaggcgcggtggttcacgcctgtaatcccagcactttgagaggctgaggcacgtggatcacaaggtcaggagttcaagaccagcctggccaagatggtgaaaccccgtttctactaaaaatacaaaaactagctggccgtggtggcatgctcctgtagtcccagctactcaggaggctgaggcaggaaaatcacttgaacccaggaggtggaggttgcagtgaactgagaccgtgccactgcactccagcctgggtggcagagcgagactgtctcaaaaaaaaaagaaagttgtgaatttgatgtaagcttaggaaatgaataaaatttataggcatctgtataatgtacaacttgacacggactttcttttatccttagtttctttcacggactctagaacttttatcagaatatactggtaaaacattgggggagggatcctgagtaggtgattggtcagaaagatgccttcagttttgtcagtgtctaaaagttaagtctgtttaggccaagcatggtggctcacacctgaaatcccagcactctgggaggccgaggcaagtggatcacaaggtcaggagatgagaccatcttagccaacatggtgaaaccccgtctctactaaaatacaaaaaaattagccaggcgtggtggtgcgtgcctataatcccagctacttgggaggctgaggcaggggaatcgcttgaacccgggaggcagaggtcacgccactgcactccagcctggcaacagagcaagactccgtctcaaaaaaaaaaaaaaaaaaaaagagtaagtctgtgtaacatgaacatctctgcttccacccaaaaccacagcctttgaatattatataaggaacttaatggatagatatgtttattatttttgatagcacaactgctttctctgctattataaggaaaactgagaatagcaggtgggtagggtaggatgaggaaacaagatgcccaaagcctagatgccacagaattcatggtgataatcagggcatattttgagtcctactagaaacaaacattccaaatgaactctgaatgcctgactcaggcgttttggaggtttgggttatccccttgtcattaggcacacaagggttttttgttgtttttgttttttgggtttttgttttgttttgaggcagtctcactctgttgtacaagctggagtgctgtattgtgatcttgactcactgcaacctctgcctcctggttcaagcgattctcctgccttggcctcctgagtagctgggattataagtgcctgccactatgcccggctaatttttgtatttttagtggagatggagttttgccatgttggccaggctggtcttgaactcctgactccaggtgatccaccctcctcagcctcccaaagtgctaggattacaggcgtgagccaccccgtccggcctgtttttaaggcattaattagtattgttaggaaagcagtaacaatgcaaacaccactcttctcttcacaaagatcaccttgagactgtgtctccattccacctgcctgagaagtgggagcatcagcctgttccaggctcttgggtagtagcatagccctttaaaaagagagagccattttccatgtgtttttggataagcacaatttgaaaatcatttcccaaatcctctttttgtttttgattctaaggtaaaattttccctaagccctcccaccatcccctcagccagtattagatgagatttgtatagcagcagaaactgacttataagtagagagctcttcagcaagactgagccttagctgttccatctctttgttcttctgttgctggagttgcaccccatttcttaactgcctctggcgttcttccatttcctccagctgttcctgcatgagatggccaagaacatttctaatgagccaaacaataaaaactcacattgtccactcttacttataaaacacttttttgttcattgtttaatcttgatagcagtattgaggctggtatttatatgataggttatgaaacaggttcaaagaagttgtgtcttggaaaaaaagtgacaatgcttttgaaaatgatgacgaaaaaggcatcttgtctgttaaccacagcttgctttaatagaatcctgggagggtgattgggactttttagtattacaaccttagtgtcattgaggaggattttggtctagttagtgggctgagtttcatatacctctccctccatgtgcaggtttgttaagataattggtagtttttaataatataaaatacttaagttgaaatacaaaagtgtggcaacaattattaaatattggctagaattctaggagagttacacaactagtggaagtccatgtttagaaaataaatggcttgtttaaggaaaagtttttgtgtccaaagctccttaaagtcagagagatttctacctggtacttaacatcatatggaaattgatgctttagtgagggtgttggctatcctattgctaatttcctgcatccttttttcttctttatttttgtatagagacagggtctcgctatgttgcccaggctggtcttgttcctgggctcaagcagtcctcccgcctcggtctcccaaagtgctgggattacaggtgtgagccactgtgcccagcttatccttttttcattacacaaaaagactgaatttggttagttctaagttggaagataaagatggtatgcacaggaggcccttgggagccctcagataactttctcattcttccagaatcaggctgggatgcattctgtaaattttccctgcctaggatgtatacctgaggaataaggtaaggaagatgtcagcaagtcagtctctggtttacctgctagctggcatggatccttaaggaagcaggagggagttgggaagagaggaaggggtgaagttggtatcttttaaagcgagagtgattttacctcagattttgaagaatactaaggaatccagttgttggggtacatgctattattagaaggatctagataatttgtcctctgagtcatacttgacattgtacctgtggcacatcaatccgcactgtttgatactctggctgaatctcagctttcaccaacattgtcaaaggaccttttttagtgcccagccatgcctaagagtgtgtcatctgaagagggaagcatctgcatactgctgtcctgattgctcagtcctcactacctaccagacccgttggtaaggtacaaaagtacatgcttggaaaagcagtctgcaccaccagtgataagctgtgacagagtggaacagcctcaatgaaatgaaggaaggattgctacagtggcattaaggatggtctcttaatcctgtgttaaccactagattaactttacaatcaactcaaaatccttcaaaggctttccactttctttagtggcattcagaccccctctagtttgacccctacctccaacttgaacctctgttactcttccgtatgaacattttcctctagccctggactactagtaccgaagtcactagtcacataggactcatttgaaatatgactagtctcaattgagatgtaatgtaagtgtaaaatacacagcagatttctaagacagcacacaaaatgtaaaatatgtcaaaaatatttgatactgattacatgttgaaatatatgtgttgggttaaataaaatgcattaaagttaa

SEQ ID NO: 175306 - DNA, 580 bp, Homo sapiens
  Payload ID: 14434
  Gene Symbol: RBBP4
  Gene Name: retinoblastoma binding protein 4
  ENST ID: ENST00000445722
  CDS Start-End: 319-580
ttccctgggaccgatttcggtcgcagctggcgaagccagcggtggggcccccggccagtgtttgtttctcttcctgcctccgatatcggtttctcggcctctgtcccgagcgtggggacaccgcttcctacccacaaggctcggagctcgggcctcctcgtcgggcttgtgagtttcggcgcgcacgagcgtgctccgaaggcctggctggccccttggcctggaacggcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaacc

SEQ ID NO: 175307 - DNA, 1674 bp, Homo sapiens
  Payload ID: 14434
  Gene Symbol: RBBP4
  Gene Name: retinoblastoma binding protein 4
  Uniprot ID: Q09028
  ENST ID: ENST00000458695
  CDS Start-End: 167-1339
gggtgcctgggctgagccgcggcctcgacatggcctaacagtgagggcaggcccgagtttgccgagtgcagtccccgcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagag

SEQ ID NO: 175308 - DNA, 1788 bp, Homo sapiens
  Payload ID: 14434
  Gene Symbol: RBBP4
  Gene Name: retinoblastoma binding protein 4
  Uniprot ID: Q09028
  ENST ID: ENST00000414241
  CDS Start-End: 166-1440
aggagcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaata

SEQ ID NO: 175309 - DNA, 783 bp, Homo sapiens
  Payload ID: 14434
  Gene Symbol: RBBP4
  Gene Name: retinoblastoma binding protein 4
  ENST ID: ENST00000460669
  CDS Start-End: 1-543
gttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggagttagtccttgaccactagtttgatgccatctccattttgggtgacctgtttcaccagcaggcctgttactctccatgactaactgtgtaagtgcttaaaatggaataaattgcttttctacataa

SEQ ID NO: 175310 - DNA, 544 bp, Homo sapiens
  Payload ID: 14434
  Gene Symbol: RBBP4
  Gene Name: retinoblastoma binding protein 4
  ENST ID: ENST00000477563
  CDS Start-End: 30-344
ccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggaggctgagtgcagtggtgcgatctcactgcagcctccgcctcctgggttcaagtgattctcctgcctcagcctcctgagtagctgggattacagaatttggaggttttggttcagttagtggaaaaattgaaatagaaatcaagatcaaccatgaaggagaagtaaacagggcccgttatatgccccagaacccttgtatcatcgca

SEQ ID NO: 175311 - DNA, 700 bp, Homo sapiens
  Payload ID: 14434
  Gene Symbol: RBBP4
  Gene Name: retinoblastoma binding protein 4
  ENST ID: ENST00000527118
  CDS Start-End: 130-318
gcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccat

SEQ ID NO: 175312 - DNA, 882 bp, Homo sapiens
  Payload ID: 14434
  Gene Symbol: RBBP4
  Gene Name: retinoblastoma binding protein 4
  ENST ID: ENST00000463378
  CDS Start-End: 1-788
ctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatgatggtctctcactttttcacccaggctggagtgcaatggtgcaatctcggctcactgcaacttccacctcccaggttcgatcgattctcctgcctcagccttctgagtagctgggactataggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgtt

SEQ ID NO: 175313 - DNA, 568 bp, Homo sapiens
  Payload ID: 14434
  Gene Symbol: RBBP4
  Gene Name: retinoblastoma binding protein 4
  ENST ID: ENST00000526193
  CDS Start-End: 91-354
agaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagc

SEQ ID NO: 175314 - DNA, 616 bp, Homo sapiens
  Payload ID: 14434
  Gene Symbol: RBBP4
  Gene Name: retinoblastoma binding protein 4
  ENST ID: ENST00000482190
  CDS Start-End: 1-504
tccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatgggcaggcagagaacatttataatgatgaagaccctgaaggaagcgtggatccagaaggacaagggagttagtccttgaccactagtttgatgccatctccattttgggtgacctgtttcaccagcaggcctgttactctccatgactaactgtgtaagtgcttaaaatggaataaattgcttttctacat

SEQ ID NO: 175315 - DNA, 1547 bp, Homo sapiens
  Payload ID: 14434
  Gene Symbol: RBBP4
  Gene Name: retinoblastoma binding protein 4
  ENST ID: ENST00000492348
  CDS Start-End: 91-354
agaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcatatagattcctactcgaaaatcttgacacctgactttccaggatgcacattttcatacgtaga

SEQ ID NO: 175316 - DNA, 619 bp, Homo sapiens
  Payload ID: 14434
  Gene Symbol: RBBP4
  Gene Name: retinoblastoma binding protein 4
  ENST ID: ENST00000475321
  CDS Start-End: 1-619
gaacccttgtatcatcgcaacaaagactccttccagtgatgttcttgtttttgactatacaaaacatccttctaaaccagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatg

SEQ ID NO: 175317 - DNA, 632 bp, Homo sapiens
  Payload ID: 14434
  Gene Symbol: RBBP4
  Gene Name: retinoblastoma binding protein 4
  ENST ID: ENST00000490500
  CDS Start-End: 428-632
agttccctgggaccgatttcggtcgcagctggcgaagccagcggtggggcccccggccagtgtttgtttctcttcctgcctccgatatcggtttctcggcctctgtcccgagcgtggggacaccgcttcctacccacaaggctcggagctcgggcctcctcgtcgggcttgtgagtttcggcgcgcacgagcgtgctccgaaggcctggctggccccttggcctggaacgggtaacggagtgtttggcggggatggcccgaggagtttcggcgccgcgaaagtggagagtgtggatgcctctgccgtggggatttagacaaatcacctccatttcatgcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggag

SEQ ID NO: 175318 - DNA, 4404 bp, Homo sapiens
  Payload ID: 14435
  Gene Symbol: RBBP5
  Gene Name: retinoblastoma binding protein 5
  Uniprot ID: Q15291
  ENST ID: ENST00000264515
  CDS Start-End: 143-1759
gcggggccttctaaggccgaaagtcttcggagcttgcgccagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacaactggaacaagcaataccacagccattaagtcaattgagtttgcccggaaggggagttgctttttaattaacacggcagatcgaataatcagagtttatgatggcagagaaatcttaacatgtggaagagatggagagcctgaacctatgcagaaattgcaggatttggtgaataggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagagtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaaggtaaagagaaagattctccatttaaaccgaaactctacaaaggggacagaggtttacctctggaaggatcagcgaagggtaaagtgcaggcggaactcagccagcccttgacagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttgactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtagtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccacgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgtttattaaagaa

SEQ ID NO: 175319 - DNA, 4290 bp, Homo sapiens
  Payload ID: 14435
  Gene Symbol: RBBP5
  Gene Name: retinoblastoma binding protein 5
  Uniprot ID: Q15291
  ENST ID: ENST00000367164
  CDS Start-End: 143-1645
gcggggccttctaaggccgaaagtcttcggagcttgcgccagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacaactggaacaagcaataccacagccattaagtcaattgagtttgcccggaaggggagttgctttttaattaacacggcagatcgaataatcagagtttatgatggcagagaaatcttaacatgtggaagagatggagagcctgaacctatgcagaaattgcaggatttggtgaataggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagagtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttgactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtagtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccacgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgtttattaaagaa

SEQ ID NO: 175320 - DNA, 5739 bp, Homo sapiens
  Payload ID: 14436
  Gene Symbol: RBBP6
  Gene Name: retinoblastoma binding protein 6
  Uniprot ID: Q7Z6E9
  ENST ID: ENST00000348022
  CDS Start-End: 45-5321
agtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagagtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcaaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaa

SEQ ID NO: 175321 - DNA, 6229 bp, Homo sapiens
  Payload ID: 14436
  Gene Symbol: RBBP6
  Gene Name: retinoblastoma binding protein 6
  Uniprot ID: Q7Z6E9
  ENST ID: ENST00000319715
  CDS Start-End: 433-5811
gagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagaggaaaagaaaaagtccaagctagatgagtttacaaatgattttgctaaggaattgatggaatacaaaaagattcaaaaggagcgtaggcgctcattttccaggtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcaaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaa

SEQ ID NO: 175322 - DNA, 3384 bp, Homo sapiens
  Payload ID: 14436
  Gene Symbol: RBBP6
  Gene Name: retinoblastoma binding protein 6
  Uniprot ID: Q7Z6E9
  ENST ID: ENST00000381039
  CDS Start-End: 108-2966
gtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcaaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaa

SEQ ID NO: 175323 - DNA, 854 bp, Homo sapiens
  Payload ID: 14436
  Gene Symbol: RBBP6
  Gene Name: retinoblastoma binding protein 6
  Uniprot ID: Q7Z6E9
  ENST ID: ENST00000452655
  CDS Start-End: 132-488
tctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcagtatgtaaaaacacaatctcacactttttctacacattgcttttacctttataatgtagcagtgaagtaaatcattttagaacttaatatccaactgatcatagtacatattgtaaataaaatgtattttgatgacagctcagttgaatatggataatatgtggcatcacttgcacacttattttgtagaaatgggtaatttgtgcccgtaacactgtttcatattaaatatgatagcattatccctgtatgacactgtgttgtacagttaatgtatgatcctttttagatcgtttaggttttacactaaggaacatgatgacatgttctacatttgtctgtctatagttagtattttgtatgtatgtacaggctgttgtgtgctttttgtttcttgcaataaaaaatgtttggagtgta

SEQ ID NO: 175324 - DNA, 3361 bp, Homo sapiens
  Payload ID: 14436
  Gene Symbol: RBBP6
  Gene Name: retinoblastoma binding protein 6
  ENST ID: ENST00000564314
  CDS Start-End: 338-3361
atgatgcaccacgctgattaaattaggcattcagtatataaaggggtcggccacagacgggcaaaaggaacagattcaccgcttcggagtgaattccatgacggcttgcaattttctcgtcgagtttttctttcactagagatagccctcgccctttcattcacacagaggcttttaagaaaaaagcaaccaacctgaagaggacctggcagcaataagtttttggtgaaataacaaagagattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagaggaaaagaaaaagtccaagctagatgagtttacaaatgattttgctaaggaattgatggaatacaaaaagattcaaaaggagcgtaggcgctcattttccaggtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgat

SEQ ID NO: 175325 - DNA, 1138 bp, Homo sapiens
  Payload ID: 14436
  Gene Symbol: RBBP6
  Gene Name: retinoblastoma binding protein 6
  ENST ID: ENST00000567686
  CDS Start-End: 238-1138
aaattaggcattcagtatataaaggggtcggccacagacgggcaaaaggaacagattcaccgcttcggagtgaattccatgacggcttgcaattttctcgtcgagtttttctttcactagagatagccctcgccctttcattcacacagaggcttttaagaaaaaagcaaccaacctgaagaggacctggcagcaataagtttttggtgaaataacaaagaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatc

SEQ ID NO: 175326 - DNA, 695 bp, Homo sapiens
  Payload ID: 14436
  Gene Symbol: RBBP6
  Gene Name: retinoblastoma binding protein 6
  ENST ID: ENST00000568015
  CDS Start-End: 220-695
aagagaccccgcagtggggcgctcgtccgaagccaggccgcgtccgccatagtacctggcttggaggtgtcgccgccgctcggtgagagcccccgagcggcagggggccaacacaaaaagggagccggagaagccctagccgctgcccagcagcttgcgggcgtgttctcgcggttccgggcctcaaggcgacggaaacgaaaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatctta

SEQ ID NO: 175327 - DNA, 529 bp, Homo sapiens
  Payload ID: 14436
  Gene Symbol: RBBP6
  Gene Name: retinoblastoma binding protein 6
  ENST ID: ENST00000562683
  CDS Start-End: 1-415
gaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtaagaagtgctgaatcttggaagatgtatattttagaatatttgtatttacttggaatggctcttcccaacctcatatgttttaataataaaataaataatgttgatgacaagtgttgatcaatgag

SEQ ID NO: 175328 - DNA, 2036 bp, Homo sapiens
  Payload ID: 14437
  Gene Symbol: RBBP7
  Gene Name: retinoblastoma binding protein 7
  Uniprot ID: Q16576
  ENST ID: ENST00000380084
  CDS Start-End: 246-1655
gcgggacgggaccgccgcgccgagggctccgagcacttccggagccgggcgcggggccgagggctgggcccccctcttcccttccctcctccagcggctgcgctccctccggcgccctcggccccggggcggaggcggcccccgccgctgggaagcgagcgccgcggctctttctacgcgcgcgcgcgcgttgaccgcctcggggtcgcggcccttgtccgggggttgctggggtcctcaggcctatggctgccgaggcgggcgtcgtgggagctggggcctcccctgatggggattggagagaccaggcctgtgggcttctgctacacgtgcatttgtcttcccgactgggtcgcgcagcccctgtacgtacaggtcgtcatcttagaacagtgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaat

SEQ ID NO: 175329 - DNA, 2333 bp, Homo sapiens
  Payload ID: 14437
  Gene Symbol: RBBP7
  Gene Name: retinoblastoma binding protein 7
  Uniprot ID: Q16576
  ENST ID: ENST00000380087
  CDS Start-End: 362-1639
ggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaa

SEQ ID NO: 175330 - DNA, 1904 bp, Homo sapiens
  Payload ID: 14437
  Gene Symbol: RBBP7
  Gene Name: retinoblastoma binding protein 7
  ENST ID: ENST00000404022
  CDS Start-End: 309-1559
cttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacac

SEQ ID NO: 175331 - DNA, 857 bp, Homo sapiens
  Payload ID: 14437
  Gene Symbol: RBBP7
  Gene Name: retinoblastoma binding protein 7
  ENST ID: ENST00000416035
  CDS Start-End: 1-857
gctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataaggtatgtgacagttttctggtgtctgtatgtcaggaaatgaaatccagggattcatcagttaagctataccagactcgtgggtccactattgaaaaaaatgtcttgtacgtggtgttacatggagatgctcatagggtccactggtctccacataatgaaactattctggcttcaagtggtactgaccgccgcctgaatgtgtgggatttaag

SEQ ID NO: 175332 - DNA, 763 bp, Homo sapiens
  Payload ID: 14437
  Gene Symbol: RBBP7
  Gene Name: retinoblastoma binding protein 7
  ENST ID: ENST00000444437
  CDS Start-End: 1-528
gatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctggtacgcattggcttatagaagatgaaatgtcatatgcagattggattgtcattgatctctttatttcgagaatgggtcagaacttcgaattctagctcttgcagatggtttcaaaatggaggccctgaaggttattgcaactgggctttgacatttatcaaaaatagtaaatggagcccagtaggtttttatgaatgtttcactgagaatggtttgaggtcctggaaaatagtatatagtaatttctcactga

SEQ ID NO: 175333 - DNA, 373 bp, Homo sapiens
  Payload ID: 14437
  Gene Symbol: RBBP7
  Gene Name: retinoblastoma binding protein 7
  ENST ID: ENST00000425696
  CDS Start-End: 1-258
ctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaaattcttgggaggacagcgatcttcagccccacaagacattaagaactgacactccaccacaacctccaagaacacatcagtttcagaactcaaggcagcatgattcag

SEQ ID NO: 175334 - DNA, 212 bp, Homo sapiens
  Payload ID: 14437
  Gene Symbol: RBBP7
  Gene Name: retinoblastoma binding protein 7
  ENST ID: ENST00000493145
  CDS Start-End: 101-212
gtgacgcgcttgggaaaggcaggagcgccagcggtcgggctgctcttggctaacgagaggagtccgaggcggcggcgaggggcgaacgacccgacgcaagatggcgatgtttgaagatactgtggaggagcgtgtcatcaatgaagaatataaaatctggaagaagaatacaccgtttctatatgacctggttatgacccatgctcttcagt

SEQ ID NO: 175335 - DNA, 630 bp, Homo sapiens
  Payload ID: 14437
  Gene Symbol: RBBP7
  Gene Name: retinoblastoma binding protein 7
  ENST ID: ENST00000468092
  CDS Start-End: 428-630
gcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagaccacttaatcgtgtgggctttctccaaatttcagtgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaaggg

SEQ ID NO: 175336 - DNA, 3288 bp, Homo sapiens
  Payload ID: 14438
  Gene Symbol: RBBP8
  Gene Name: retinoblastoma binding protein 8
  Uniprot ID: Q99708
  ENST ID: ENST00000327155
  CDS Start-End: 349-3042
aagtggaactcccgcgtgacgtcgcgcgggctcccgggcggggcgggtccggccgcctccgagcccggccggcagcccccggccttaaagcgcgggctgtccggaggggtcggctttcccaccgaggatttggcactctggtgagggaaaagggcgaaagagaaaagcgagcagccgtcctttcacagcctcagaaagtgctcgcttcccttcgggggctttcgcgaatcccgaggcaatctcggaggcggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 175337 - DNA, 2962 bp, Homo sapiens
  Payload ID: 14438
  Gene Symbol: RBBP8
  Gene Name: retinoblastoma binding protein 8
  ENST ID: ENST00000360790
  CDS Start-End: 124-2832
ttgagaacatgcgggctacagagaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaatgctcttttacatagatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaa

SEQ ID NO: 175338 - DNA, 2229 bp, Homo sapiens
  Payload ID: 14438
  Gene Symbol: RBBP8
  Gene Name: retinoblastoma binding protein 8
  ENST ID: ENST00000399721
  CDS Start-End: 488-2229
cgcacgcggaaccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtaagacgtgacgttctgagagattgaaaaatgtacattgtcgtcgtgcctcgaataacggttcattgcagagagagatgctaacaaaaagtgccgggcatgcgggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaa

SEQ ID NO: 175339 - DNA, 3293 bp, Homo sapiens
  Payload ID: 14438
  Gene Symbol: RBBP8
  Gene Name: retinoblastoma binding protein 8
  Uniprot ID: Q99708
  ENST ID: ENST00000399722
  CDS Start-End: 352-3045
tgcgccgactgcggctcgcgcgcgcgcttcggaggttttttggccagacccgcacgcggaaccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaata

SEQ ID NO: 175340 - DNA, 3260 bp, Homo sapiens
  Payload ID: 14438
  Gene Symbol: RBBP8
  Gene Name: retinoblastoma binding protein 8
  Uniprot ID: Q99708
  ENST ID: ENST00000399725
  CDS Start-End: 418-3021
tcgcgcgcgcgcttcggaggttttttggccagacccgcacgcggaaccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagtattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 175341 - DNA, 543 bp, Homo sapiens
  Payload ID: 14438
  Gene Symbol: RBBP8
  Gene Name: retinoblastoma binding protein 8
  ENST ID: ENST00000579124
  CDS Start-End: 351-543
gcactcagtatatagcttagatgcagcagaactcttccacatagcagtagtgtctagcaaaccagtgtggtccagagaggtggtgttcactgatttaatgtttaagttgatagattcagggaaagtgagcagtgaaacaatttctgcttttcaccaagagcagaggttttctaaataagtcgaaggggaaaacccttggatgcttcatagtcctacttctaggcagttctgcatgaatttctggtaatccaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaac

SEQ ID NO: 175342 - DNA, 480 bp, Homo sapiens
  Payload ID: 14438
  Gene Symbol: RBBP8
  Gene Name: retinoblastoma binding protein 8
  ENST ID: ENST00000577445
  CDS Start-End: 1-480
tgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccactacagttgttgctgaaacacttggacttggtgttcaagaagaatctgaaactca

SEQ ID NO: 175343 - DNA, 574 bp, Homo sapiens
  Payload ID: 14438
  Gene Symbol: RBBP8
  Gene Name: retinoblastoma binding protein 8
  ENST ID: ENST00000581819
  CDS Start-End: 322-574
agatgcagcagaactcttccacatagcagtagtgtctagcaaaccagtgtggtccagagaggtggtgttcactgatttaatgtttaagttgatagattcagggaaagtgagcagtgaaacaatttctgcttttcaccaagagcagaggttttctaaataagtcgaagggaggatattgccgtagaagaggttgatggtagcttgaaccagggtggacacaaaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaa

SEQ ID NO: 175344 - DNA, 617 bp, Homo sapiens
  Payload ID: 14438
  Gene Symbol: RBBP8
  Gene Name: retinoblastoma binding protein 8
  ENST ID: ENST00000581687
  CDS Start-End: 142-369
agctttgttaatttaattcatttttcccccagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaata

SEQ ID NO: 175345 - DNA, 1019 bp, Homo sapiens
  Payload ID: 14438
  Gene Symbol: RBBP8
  Gene Name: retinoblastoma binding protein 8
  ENST ID: ENST00000582354
  CDS Start-End: 404-1019
actcagtatatagcttagatgcagcagaactcttccacatagcagtagtgtctagcaaaccagtgtggtccagagaggtggtgttcactgatttaatgtttaagttgatagattcagggaaagtgagcagtgaaacaatttctgcttttcaccaagagcagaggttttctaaataagtcgaaggggaaaacccttggatgcttcatagtcctacttctaggcagttctgcatgaatttctggtaatccaggaggatattgccgtagaagaggttgatggtagcttgaaccagggtggacacaaaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaag

SEQ ID NO: 175346 - DNA, 578 bp, Homo sapiens
  Payload ID: 14438
  Gene Symbol: RBBP8
  Gene Name: retinoblastoma binding protein 8
  ENST ID: ENST00000577588
  CDS Start-End: 490-578
actcagtatatagcttagatgcagcagaactcttccacatagcagtagtgtctagcaaaccagtgtggtccagagaggtggtgttcactgatttaatgtttaagttgatagattcagggaaagtgagcagtgaaacaatttctgcttttcaccaagagcagaggttttctaaataagtcgaaggggaaaacccttggatgcttcatagtcctacttctaggcagttctgcatgaatttctggtaatccagaactgacaggaaaattttgttatgaagacagaaattgcaggacttaaaaacccatcttagaggtgatagaagctgttattgaaggggaggatattgccgtagaagaggttgatggtagcttgaaccagggtggacacaaaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatg

SEQ ID NO: 175347 - DNA, 564 bp, Homo sapiens
  Payload ID: 14438
  Gene Symbol: RBBP8
  Gene Name: retinoblastoma binding protein 8
  ENST ID: ENST00000583700
  CDS Start-End: 533-564
agtgcaatggcgagatctcggctcactgcaacctccgccccccaagttcaaacggttccccttttgaagagagcaattcagagggccattaactatataagcacaagaaaagtccaaagatcctggagctacctagggaacagagctccaaagaaagcctcctgcgtggaagcttccctgaggaagagctgataacaccttaaacctcctctggattcaagttaaagaattaacacagaagacttctgcagccaaatgtgtggagattttcccctaccaacaagcaagtaatgaattctgcagcagataccagggaaaacccttggatgcttcatagtcctacttctaggcagttctgcatgaatttctggtaatccaggaggatattgccgtagaagaggttgatggtagcttgaaccagggtggacacaaaggtatttgacctgtccaaagacgacttgatacctctataatgtaacagaaaaggtcagaaaatattaagcaagtagaagtgtggagcatattaagcaagatgaacatctcgggaagcagctgtggaagccc

SEQ ID NO: 175348 - DNA, 1195 bp, Homo sapiens
  Payload ID: 14438
  Gene Symbol: RBBP8
  Gene Name: retinoblastoma binding protein 8
  ENST ID: ENST00000583057
  CDS Start-End: 1-975
ccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacaagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaa

SEQ ID NO: 175349 - DNA, 606 bp, Homo sapiens
  Payload ID: 14438
  Gene Symbol: RBBP8
  Gene Name: retinoblastoma binding protein 8
  ENST ID: ENST00000585177
  CDS Start-End: 1-136
aaataaaaagctttctgaacaactccagcagaaaattgagaccatcttaagcaagtctcttctcctgtgctacttgacgactcttttgatacatgaagacagctatcatggccctcctgagtcttgttttctctagagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctaca

SEQ ID NO: 175350 - DNA, 3861 bp, Homo sapiens
  Payload ID: 14439
  Gene Symbol: RBBP9
  Gene Name: retinoblastoma binding protein 9
  Uniprot ID: O75884
  ENST ID: ENST00000337227
  CDS Start-End: 77-637
cgcaggctccctgcgggagcaggctgggctcagctccgctggacccgcgctggggaactctggcctcgctgcactcatggcttctcctagcaaggcagtgattgttcccgggaacggaggcggggatgtgaccacccacggctggtatggctgggtgaaaaaggagctggagaagatacctggtttccagtgtttggctaaaaacatgcccgacccaattacagcacgagagagcatctggctgcccttcatggagacagagctgcactgtgatgagaagactatcatcattggccacagttctggggccatcgcggccatgaggtatgcagaaacacatcgagtatatgctattgtattagtgtctgcgtacacatcagacttgggggatgaaaatgagcgtgcaagtggatacttcacccgcccctggcagtgggagaagatcaaggccaactgcccttacattgtgcagtttggctctactgacgacccgttccttccctggaaggaacaacaagaagtggccgataggttggaaaccaaattgcacaaattcactgactgtggccactttcagaacacagagtttcatgaactgattactgttgtaaagtctttgctgaaagtaccagcatagactgtatgatttctgctattttgcatcccaatataggagtagaataatatctactatcagctgattactagacacatagaacatccagttaagttccgtaagtgcctgaaaaacaaacacaagtttcaacattcaatctaagttacaaatagcacttccattttccatagactctaaaactccccaaattgctatgaactaccacagtattttcctcatttgataagaaacataaggacagcttaactacccttctctatccgaagtgagtcagaaacagaacccaggtttcttgattcccactcctgagtaaaattaaataggttttatgtatgttgcaggtattgcacacttttcctctttgaaatcaaacttttctatttcactggggaaagaaaacatgactgaaagtccagagtgttagcttagagctcaaaatactagctgctgtttcaagctggccccagacattaaactcagactagggccttcacctctgacacttgcccctaagtccttcagacatgttgagagagactgagacaggagtcttccggagtcaggcaggaaggagaagcacagcaatatacattcataatatacgtacaactgactagatttgtttgagacaagagtggtgggatcagagccatgtggagagctcatggcctgtctaaattgttgccatgtggaaatggggcagagtgttgccaattttctgattttttgtgtggaaaaaaatctccaaattgtagtttttaaatttggggaatgcaaatatatatatatatacacacacacacacacacatacacatacaatccatatacatatggagtatgtaagttggcaataacagtatacatcaaaaaatttacaaacactgcaagacaaataaaatccaagccatccatttgtgaccacagtcataagcattcacttagccaggggcttttagataattgtctgtgaagtctgagaaaagactaagataaccaagatgaacataatgtcaaaggacgaaatcatggggacaatttggattttgttccaaaagacaagtgtttttaaaaagaacctttccatacttcgtgttctgttctatagagttaaaccttttaacttccatggccctttagatctctttcaagcacattccattttcttctgatcatacttcctcagaaaacctttttttggctgggtgtggtggctcatgcctgtaatcccagcactgtgggaggctgaggtggttgtattgcttgaggccaggtgtttgaggccagccagggcaacacagcaagaccccatctctacaaaatattaaaacattagctaggcatggtggtgcacacctgtagtcctagcttcttgggaggctgaggcaggattgcttgagcccaggagtttgagccttcagtgagctatgatcgcgccactgtactccatcctgggtgatggagcgaagaacctgtctcttaaaaaaaaaaatttttttttaattaaaaaaacccaccctttttcatttcccaacattttttggctattatgatcgctatgtgttccttcaaataatttccagtgaatccacacttgatgttgcaaagcctaagtttgctgcagaaatacaatttcctacacttcatacctaaaggagattcagagctatcgctcaaaaccaaaagtcttggtttttaaatgtgcttagacaaaaaaaatcaggaaaggtaccctaatcgttcaacagcaatcatctttggggaatgggcattttggtaggtaaagtgtggtggacgtccttattattatttttgagacagtgtcttgctctgtctcccaggctggaggtcagtggcacaaatctcagctcactctaacctgcacctcccgggttcaagtgattctcatctcagcctcccaagtagtgtgaactaaaggcatgtgccaccacgcctggctaatttttgtatttttagtagagacagggtttcaccatgttggccaggctggtctcgaactcctggcctcaagtgatccacccacctcagccgcccaaagtgttgggattacaggcatgagccaccatgcccggccccttattttactttatcctcctgattatttgaatttgttacactaagcatgtattttataatcaaaaataattaagatttaaaacaatgtatttgactactaaaaagcaaattatataaatcagttgaataataatgttgttaaagaggctgtttagcactaatttgaccaaatctatagtcaaagtttgattctacttgaattttttggaaatttgctgttgtattacttattctttgccttgttctctgtgaagtcctttcctaaaaaagaaacttatacaatttagttcacaaaactttgttgacctctttctctgtagaaatgaaaactaaatatatataattgagaaataattctgatactcttcattcctataaaagtaattaagatagacctataggattgttgaactttgctgccaaatatagtaaccagtaaccacagctagctgtaaaattgaaaattcagttcagtcaaactagccatatttcaagtgctcaacagccactggtggctattggttaccttactgaccagccaatataggctatttccgtcattatagaaagctctattggacaacattggtctaggacatatattttgtattttcccctcacccaccatccaataatgagtaatagcacaaagtaaaagtgacttaatttgaaattacttctgtttggctagtttgcttagctgatcaccaccaacatcataggtctataaatcacccaactaagatcaggggtgtttcatgggaaaatctacacaaactattcattaaaaaccatagagccatggactgtcatttctgatttctgtttgattctttgtggtcatcattgaatatacaggggcctctatacactctggggagtatctattctcaggtgagcaaaataccgaatactgaatggaaatcaactgtaagtattaggacttcatatgcaacttgaatttttggtgctgtccggagtctagagccccacaatctgttttggttacagtttatccctgtaggataaatgatccatttaactattcatcagaggtgctgtaattttaaattgtctcttgtctccttcagttaattttcagaattaaaaacataccatgggaaaaaa

SEQ ID NO: 175351 - DNA, 522 bp, Homo sapiens
  Payload ID: 14439
  Gene Symbol: RBBP9
  Gene Name: retinoblastoma binding protein 9
  ENST ID: ENST00000622282
  CDS Start-End: 1-522
atggcttctcctagcaaggcagtgattgttcccgggaacggaggcggggatgtgaccacccacggctggtatggctgggtgaaaaaggagctggagaagatacctggtttccagtgtttggctaaaaacatgcccgacccaattacagcacgagagagcatctggctgcccttcatggagacagagctgcactgtgatgagaagactatcatcattggccacagttctggggccatcgcggccatgaggtatgcagaaacacatcgagtatatgctattgtattagtgtctgcgtacacatcagacttgggggatgaaaatgagcgtgcaagtggatacttcacccgcccctggcagtgggagaagatcaaggccaactgcccttacattgtgcagtttggctctactgacgacccgttccttccctggaaggaacaacaagaagtggccgataggtggaaaccaaattgcacaaattcactgactgtggccactttcagaacacagagtttcatgaactga

SEQ ID NO: 175352 - DNA, 3225 bp, Homo sapiens
  Payload ID: 14440
  Gene Symbol: RBL1
  Gene Name: retinoblastoma-like 1
  Uniprot ID: P28749
  ENST ID: ENST00000344359
  CDS Start-End: 62-3106
cgcgcctgggagggagaaagaagtcgggggccgtggcgcgcagcccgcggggcctgaagggatgttcgaggacaagccccacgctgagggggcggcggtggtcgccgcagccggggaggcgctacaggccctgtgccaggagctgaacctggacgaggggagcgcggccgaagccctggacgactttactgccatccgaggcaactacagcctagagggagaagttacacactggttggcatgttcattatatgttgcatgccgcaaaagcattattcccacggttggaaagggtatcatggaaggcaactgtgtttcacttaccagaatactacgttcagctaaattaagtttaatacaattttttagtaaaatgaagaaatggatggacatgtcaaatctaccacaagaatttcgtgaacgtatagaaaggctagagagaaattttgaggtgtctactgtaatattcaaaaaatatgagccaatttttttagatatatttcaaaatccatatgaagaaccaccaaagttaccacgaagccggaagcagaggaggattccttgcagtgttaaggatctgtttaatttctgttggacactttttgtttatactaagggtaattttcggatgattggggatgacttagtaaactcttatcatttacttctatgctgcttggatctgatttttgccaatgcgattatgtgcccaaatagacaagacttgctaaatccatcatttaaaggtttaccatctgattttcatactgctgactttacggcttctgaagagccaccctgcatcattgctgtactgtgtgaactgcatgatggacttctcgtagaagcaaaaggaataaaggagcactactttaagccatatatttcaaaactctttgacaggaagatattaaaaggagaatgcctcctggacctttcaagttttactgataatagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaaaaaaggtcatttgcaccttctaccccactgaccggacggagatatttacgagaaaaagaagcagtcattactcctgttgcatcagccacccaaagtgtgagccggttacagagtattgtggctggtctgaaaaatgcaccaagtgaccaacttataaatatttttgaatcttgtgtgcgtaatcctgtggaaaacattatgaaaatactaaaaggaataggagagactttctgtcaacactatactcaatcaacagatgaacagccaggatctcacatagactttgctgtaaacagactaaagctggcagaaattttgtattataaaatactagagactgtaatggttcaggaaacacgaagacttcatggaatggacatgtcagttcttttagagcaagatatatttcatcgttccttgatggcttgttgtttggaaattgtgctctttgcctatagctcacctcgtacttttccttggattattgaagttctcaacttgcaaccattttacttttataaggttattgaggtggtgatccgctcagaagaggggctctcaagggacatggtgaaacacctaaacagcattgaagaacagattttggagagtttagcatggagtcacgattctgcactgtgggaggctctccaggtttctgcaaacaaagttcctacctgtgaagaagttatattcccaaataactttgaaacaggaaatggaggaaatgtgcagggacatcttcccctgatgccaatgtctcctctaatgcacccaagagtcaaggaagttcgaactgacagtgggagtcttcgaagagatatgcaaccattgtctccaatttctgtccatgaacgctacagttctcctaccgcagggagtgctaagagaagactctttggagaggaccccccaaaggaaatgcttatggacaagatcataacagaaggaacaaaattgaaaatcgctccttcttcaagcattactgctgaaaatgtatcaattttacctggtcaaactcttctaacaatggccacagccccagtaacaggaacaacaggacataaagttacaattccattacatggtgtcgcaaatgatgctggagagatcacactgatacctctttccatgaatacaaatcaggagtccaaagtcaagagtcctgtatcacttactgctcattcattaattggtgcttctccaaaacagaccaatctgactaaagcacaagaggtacattcaactggaataaacaggccaaagagaactgggtccttagcactattttacagaaaggtctatcatttggcaagtgtacgcttacgtgatctatgtctaaaactggatgtttcaaatgagttacgaaggaagatatggacgtgttttgaattcactttagttcactgtcctgatctaatgaaagacaggcatttggatcagctcctcctttgtgccttttatatcatggcaaaggtaacaaaagaagaaagaacttttcaagaaattatgaaaagttataggaatcagccccaagctaatagtcacgtatatagaagtgttctgctgaaaagtattccaagagaagttgtggcatataataaaaatataaatgatgactttgaaatgatagattgtgacttagaagatgctacaaaaacacctgactgttccagtggaccagtgaaagaggaaagaggtgatcttataaaattttacaatacaatatatgtaggaagagtgaagtcatttgcactgaaatacgacttggcgaatcaggaccatatgatggatgctccaccactctctccttttccacatattaaacaacagccaggctcaccacgccgcatttcccagcagcactccatttatatttccccgcacaagaatgggtcaggccttacaccaagaagcgctctgctgtacaagttcaatggcagcccttctaaggtaaggtgaataggctaaaagttggatttcagattaacagtcagtaactgttaatcctgcctctttttttttttttcttttttggccaagttactactatactaataaaatatgaaatgttaactatg

SEQ ID NO: 175353 - DNA, 5684 bp, Homo sapiens
  Payload ID: 14440
  Gene Symbol: RBL1
  Gene Name: retinoblastoma-like 1
  Uniprot ID: P28749
  ENST ID: ENST00000373664
  CDS Start-End: 68-3274
gggtagcgcgcctgggagggagaaagaagtcgggggccgtggcgcgcagcccgcggggcctgaagggatgttcgaggacaagccccacgctgagggggcggcggtggtcgccgcagccggggaggcgctacaggccctgtgccaggagctgaacctggacgaggggagcgcggccgaagccctggacgactttactgccatccgaggcaactacagcctagagggagaagttacacactggttggcatgttcattatatgttgcatgccgcaaaagcattattcccacggttggaaagggtatcatggaaggcaactgtgtttcacttaccagaatactacgttcagctaaattaagtttaatacaattttttagtaaaatgaagaaatggatggacatgtcaaatctaccacaagaatttcgtgaacgtatagaaaggctagagagaaattttgaggtgtctactgtaatattcaaaaaatatgagccaatttttttagatatatttcaaaatccatatgaagaaccaccaaagttaccacgaagccggaagcagaggaggattccttgcagtgttaaggatctgtttaatttctgttggacactttttgtttatactaagggtaattttcggatgattggggatgacttagtaaactcttatcatttacttctatgctgcttggatctgatttttgccaatgcgattatgtgcccaaatagacaagacttgctaaatccatcatttaaaggtttaccatctgattttcatactgctgactttacggcttctgaagagccaccctgcatcattgctgtactgtgtgaactgcatgatggacttctcgtagaagcaaaaggaataaaggagcactactttaagccatatatttcaaaactctttgacaggaagatattaaaaggagaatgcctcctggacctttcaagttttactgataatagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaaaaaaggtcatttgcaccttctaccccactgaccggacggagatatttacgagaaaaagaagcagtcattactcctgttgcatcagccacccaaagtgtgagccggttacagagtattgtggctggtctgaaaaatgcaccaagtgaccaacttataaatatttttgaatcttgtgtgcgtaatcctgtggaaaacattatgaaaatactaaaaggaataggagagactttctgtcaacactatactcaatcaacagatgaacagccaggatctcacatagactttgctgtaaacagactaaagctggcagaaattttgtattataaaatactagagactgtaatggttcaggaaacacgaagacttcatggaatggacatgtcagttcttttagagcaagatatatttcatcgttccttgatggcttgttgtttggaaattgtgctctttgcctatagctcacctcgtacttttccttggattattgaagttctcaacttgcaaccattttacttttataaggttattgaggtggtgatccgctcagaagaggggctctcaagggacatggtgaaacacctaaacagcattgaagaacagattttggagagtttagcatggagtcacgattctgcactgtgggaggctctccaggtttctgcaaacaaagttcctacctgtgaagaagttatattcccaaataactttgaaacaggaaatggaggaaatgtgcagggacatcttcccctgatgccaatgtctcctctaatgcacccaagagtcaaggaagttcgaactgacagtgggagtcttcgaagagatatgcaaccattgtctccaatttctgtccatgaacgctacagttctcctaccgcagggagtgctaagagaagactctttggagaggaccccccaaaggaaatgcttatggacaagatcataacagaaggaacaaaattgaaaatcgctccttcttcaagcattactgctgaaaatgtatcaattttacctggtcaaactcttctaacaatggccacagccccagtaacaggaacaacaggacataaagttacaattccattacatggtgtcgcaaatgatgctggagagatcacactgatacctctttccatgaatacaaatcaggagtccaaagtcaagagtcctgtatcacttactgctcattcattaattggtgcttctccaaaacagaccaatctgactaaagcacaagaggtacattcaactggaataaacaggccaaagagaactgggtccttagcactattttacagaaaggtctatcatttggcaagtgtacgcttacgtgatctatgtctaaaactggatgtttcaaatgagttacgaaggaagatatggacgtgttttgaattcactttagttcactgtcctgatctaatgaaagacaggcatttggatcagctcctcctttgtgccttttatatcatggcaaaggtaacaaaagaagaaagaacttttcaagaaattatgaaaagttataggaatcagccccaagctaatagtcacgtatatagaagtgttctgctgaaaagtattccaagagaagttgtggcatataataaaaatataaatgatgactttgaaatgatagattgtgacttagaagatgctacaaaaacacctgactgttccagtggaccagtgaaagaggaaagaggtgatcttataaaattttacaatacaatatatgtaggaagagtgaagtcatttgcactgaaatacgacttggcgaatcaggaccatatgatggatgctccaccactctctccttttccacatattaaacaacagccaggctcaccacgccgcatttcccagcagcactccatttatatttccccgcacaagaatgggtcaggccttacaccaagaagcgctctgctgtacaagttcaatggcagcccttctaagagtttgaaagatatcaacaacatgataaggcaaggtgagcagagaaccaagaagcgagtaatagccatcgatagtgatgcagaatcccctgccaaacgcgtctgtcaagaaaatgatgacgttttactgaaacgactacaggatgttgtcagtgaaagagcaaatcattaatgttgttcttgtttctatgataaaagcactttcagattgttctgcagaaagttggagctctgtccttcaaaccttttagccctatagatgataaatatcactgggttataagaaaaaattgcacaaaaattatgtgctttttaaaatatttatccaaaatgtagttgacagagatgtattttgagttggattggaaaggaatattttaagtgccttttaaaaatactaatagtccggccaggcgctgtggctcacgcctgtaatcccaggactttgggaggccaaggcgggcagatcaccggaggtcaggagttcgagaccagcctgaccaacatggagaaaccccatctctactaaaaatacaaaattagccgggtgtggtggcgcatgcctgtaatcccagctacttgggaggctgaggcagaattgcttgaacccaggaagcggaggttgtggtgagccaaggttgcgccactgcactccagcctgggcaacaagagtaaaactccatctcaaaaaatatatatatatatataaatagggaattttttttaatgtttgctccttgagttttcaagatgaaataaggagaaaccccataactttttagctctcttttaaaaataaatgtctccttctgtgttctgtaatatgaggataaataatctacttttgatagcatgctttgagatatttgtattcttaatttaatattgaaggaaggggttggttcccatagtacctggccagagggttatataccatcctgtctctggcccactgtggtaattccacatccaggtaccaccgccattcagagttgtctcaccccttctcgtgccttttctctccttgagctttataaacagatttgtacctgagccccagtgctacactcatccttgctttccagccctaagccatctcagcctgatgtcacaacccaataaatggggcactttcttcttttgtaaactattatcattttggtttctgtgacattaacttaattatatatgatcgtattaactcatgtagttctcaaaataggcagctgcttctgaagccagtaaaataaaattcagttagttattaaaaactaaattcctattagtaaggtaacaccatgattatgtgtgatatactgtttttgagatcatagttatcagtcattctcaatatctaattgagtccctaagaatattttaaaccttttaaaaatcacataaatatcatctcatgcctcataattctaatatatttaatacatcagtaaaatagctgcttattacttcccacactttgttctcagtattgttagtgcatcatgagtttcctgctagtgtttgaccactgggtactcctgaagatgttttttagtactagggatgcttttcagtattagggatgcttttttcagtactagggatgtactagggagtactgagtactcctgaagatgtttttcagtactagggatgcttttttcagtgttagggatgcttttcagtactagggatgcttttttcagtgctagggatgcttttcagtactagggatgctttccaaaatatcacctctttaacgtttactttttctagtgtgtgtctggaatccaaaggacatgaataagccactcataattaattttgagaagttttatcaaatgtttatgtttctaactgcaaaccttaattttggaaaggcacaatgtttaactcacctatgtttaaccatggctaatttaaaatagtctaagatttggccgtcactaattagtattctcaagaatttcatttttcaattttaagaagaaaagggattttggtcacattttgcttgtaaatgaaaattacatcctcattctttgtgtagtatctacacattgttataagccaaaaaacaaagtctgtctggaatctttgtacatatttgtatgttgctataattgttatttttatcttcattattgtgcaaaatataaatgagcatttgtacattgactgtataagaaaccatgggccaggtcctgtggctcatgcctataatcccaacactttgggaggctgaggcaggaggattgcttcagtccaggagttcaagactaacctgggcaacatagccctcatctctacaaaaaataaaaaaattagttgggtgtgatggcatgtgcctgtagtcccagctactcaggagactgacatgagaggatcacttgagactgggagattctgaggctgcagtgagctgtgattgcaccactacactccatcctaggtgagagggcaagaccctttctcagaaaaggaaaaaaagaaattctggacatgtttttatcagttttcaggacttggtatcaatgtacatagaatggctaataaaaattggaattgagattattgaaaaaaaa

SEQ ID NO: 175354 - DNA, 763 bp, Homo sapiens
  Payload ID: 14440
  Gene Symbol: RBL1
  Gene Name: retinoblastoma-like 1
  ENST ID: ENST00000525052
  CDS Start-End: 1-763
caatttttttagatatatttcaaaatccatatgaagaaccaccaaagttaccacgaagccggaagcagagacaagacttgctaaatccatcatttaaaggtttaccatctgattttcatactgctgactttacggcttctgaagagccaccctgcatcattgctgtactgtgtgaactgcatgatggacttctcgtagaagcaaaaggaataaaggagcactactttaagccatatatttcaaaactctttgacaggaagatattaaaaggagaatgcctcctggacctttcaagttttactgataatagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaaaaaaggtcatttgcaccttctaccccactgaccggacggagatatttacgagaaaaagaagcagtcattactcctgttgcatcagccacccaaagtgtgagccggttacagagtattgtggctggtctgaaaaatgcaccaagtgaccaacttataaatatttttgaatcttgtgtgcgtaatcctgtggaaaacattatgaaaatactaaaaggaataggagagactttctgtcaacactatactcaatcaacagatgaacagcc

SEQ ID NO: 175355 - DNA, 599 bp, Homo sapiens
  Payload ID: 14440
  Gene Symbol: RBL1
  Gene Name: retinoblastoma-like 1
  ENST ID: ENST00000527999
  CDS Start-End: 68-409
gggtagcgcgcctgggagggagaaagaagtcgggggccgtggcgcgcagcccgcggggcctgaagggatgttcgaggacaagccccacgctgagggggcggcggtggtcgccgcagccggggaggcgctacaggccctgtgccaggagctgaacctggacgaggggagcgcggccgaagccctggacgactttactgccatccgaggcaactacagcctagagggagaagttacacactggttggcatgttcattatatgttgcatgccgcaaaagcattattcccacggttggaaagggtatcatggaaggcaactgtgtttcacttaccagaatactacgttcagctaaattaaggggctgctgctgccctatgtctcctggccagttgacattttggcaaccatgaagtgacctgaagcgagcctccatttactgatattataattggagccttggtaccattcacccaatctcgctgagccagcaggggtctctgtttaatacaattttttagtaaaatgaagaaatggatggacatgtcaaatctaccacaagaatttcgtgaacgtatagaaaggctagagagaaattttgag

SEQ ID NO: 175356 - DNA, 4906 bp, Homo sapiens
  Payload ID: 14441
  Gene Symbol: RBL2
  Gene Name: retinoblastoma-like 2
  Uniprot ID: Q08999
  ENST ID: ENST00000262133
  CDS Start-End: 138-3557
gtgcctgcaggcggtcagcgtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaattag

SEQ ID NO: 175357 - DNA, 2025 bp, Homo sapiens
  Payload ID: 14441
  Gene Symbol: RBL2
  Gene Name: retinoblastoma-like 2
  ENST ID: ENST00000544405
  CDS Start-End: 109-2025
gtttatcagctgtttgactgtgtgtgtggcatttaaacctgaggccatttgatttctcaagtcgttttataattaatttgtagaaagagtcgggcaaataggtccaggatgcaaagcctaaccaagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatct

SEQ ID NO: 175358 - DNA, 3897 bp, Homo sapiens
  Payload ID: 14441
  Gene Symbol: RBL2
  Gene Name: retinoblastoma-like 2
  ENST ID: ENST00000544545
  CDS Start-End: 1-2550
atggagtctcgctgtgtcgcccaggctggaatgcagtggcatgatctcggctcactgcaacctctgcctcccaggttcaagcgattcttctgcctcagcctcctgagtagctgtgaatacagtaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaatt

SEQ ID NO: 175359 - DNA, 838 bp, Homo sapiens
  Payload ID: 14441
  Gene Symbol: RBL2
  Gene Name: retinoblastoma-like 2
  ENST ID: ENST00000567964
  CDS Start-End: 454-838
ttagttaggtcttcgcccaggaatgaacaagggcagctcggaagtgagaagcgtggagtcatttaggtcagatcccttgcactgtcataactttctcactgttaggatttttgcaaaggcagtttcgtgaacgtacagagacaggcccttgctattatccctattttttagataaggatatccaggcgatgaggaagttttacttctgggaacagcctggatacgaaaccttcacacgtcagtgtcttttggacattttctcgtcagtacagccctgttgaatgttctcacggtggggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaag

SEQ ID NO: 175360 - DNA, 958 bp, Homo sapiens
  Payload ID: 14442
  Gene Symbol: RAET1E
  Gene Name: retinoic acid early transcript 1E
  Uniprot ID: Q8TD07
  ENST ID: ENST00000357183
  CDS Start-End: 134-925
gcctgacctcagttgttccagggtaaagaatttgggcagtgcccacacccacgctgttggataacatttcttcaccataccagtgagggtgaatgtgtacacgcccagcttcctgcctgttactctccacagtatgcgaagaatatccctgacttctagccctgtgcgccttcttttgtttctgctgttgctactaatagccttggagatcatggttggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaaggtatatgccaccagcacttggggagaattgacccaaacgctgggagaagtggggcgagacctcaggatgctcctttgtgacatcaaaccccagataaagaccagtgatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacagtgtcaccagtaaatgcttcagatatccactggtcttcttctagtctaccagatagatggatcatcctgggggcattcatcctgttagttttaatgggaattgttctcatctgtgtctggtggcaaaatggtgagtggcaggctggtctctggcccttgaggacgtcttagtctggtaaggactcaagagaggtgaatcatggg

SEQ ID NO: 175361 - DNA, 817 bp, Homo sapiens
  Payload ID: 14442
  Gene Symbol: RAET1E
  Gene Name: retinoic acid early transcript 1E
  Uniprot ID: Q8TD07
  ENST ID: ENST00000367363
  CDS Start-End: 134-817
gcctgacctcagttgttccagggtaaagaatttgggcagtgcccacacccacgctgttggataacatttcttcaccataccagtgagggtgaatgtgtacacgcccagcttcctgcctgttactctccacagtatgcgaagaatatccctgacttctagccctgtgcgccttcttttgtttctgctgttgctactaatagccttggagatcatgtacaacagtgacaacaacatggtcaaacctctgggcctcctggggaagaaggtatatgccaccagcacttggggagaattgacccaaacgctgggagaagtggggcgagacctcaggatgctcctttgtgacatcaaaccccagataaagaccagtgatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacagtgtcaccagtaaatgcttcagatatccactggtcttcttctagtctaccagatagatggatcatcctgggggcattcatcctgttagttttaatgggaattgttctcatctgtgtctggtggcaaaatggtgagtggcaggctggtctctggcccttgaggacgtcttag

SEQ ID NO: 175362 - DNA, 743 bp, Homo sapiens
  Payload ID: 14442
  Gene Symbol: RAET1E
  Gene Name: retinoic acid early transcript 1E
  ENST ID: ENST00000392270
  CDS Start-End: 32-385
gcccagcttcctgcctgttactctccacagtatgcgaagaatatccctgacttctagccctgtgcgccttcttttgtttctgctgttgctactaatagccttggagatcatggttggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaagatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacagtgtcaccagtaaatgcttcagatatccactggtcttcttctagtctaccagatagatggatcatcctgggggcattcatcctgttagttttaatgggaattgttctcatctgtgtctggtggcaaaatggtgagtggcaggctggtctctggcccttgaggacgtcttagtctggtaaggactcaagagaggtgaa

SEQ ID NO: 175363 - DNA, 875 bp, Homo sapiens
  Payload ID: 14442
  Gene Symbol: RAET1E
  Gene Name: retinoic acid early transcript 1E
  Uniprot ID: Q8TD07
  ENST ID: ENST00000529948
  CDS Start-End: 1-630
atgcgaagaatatccctgacttctagccctgtgcgccttcttttgtttctgctgttgctactaatagccttggagatcatggttggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaaggtatatgccaccagcacttggggagaattgacccaaacgctgggagaagtggggcgagacctcaggatgctcctttgtgacatcaaaccccagataaagaccagtgatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacaggtaactgagctgggtgggagaatgtggcagctccctttaaaggtcaaaagccttccctgtgtgggtgtcagtgtgtgtgtgcgatagaaaatttgattgacttctccgtgggcttcctgtctggagagtcagtgatggctataaggatttcccaccatcctccctttcccatcccacctcccactgtttcttcctcagtgtagaaaccccttcccattaaccaatgatccagtcacaatgacccactgctaaa

SEQ ID NO: 175364 - DNA, 643 bp, Homo sapiens
  Payload ID: 14442
  Gene Symbol: RAET1E
  Gene Name: retinoic acid early transcript 1E
  ENST ID: ENST00000531073
  CDS Start-End: 403-643
acagagactctgaggaagcagtcacctcaggcctctccatcctagagacggcagaaggacaaacatctcctgctggcacaaggaagtcataactcatgtgagtggagccatgtgggattaagaagtgataggagagcttgctgtctgtctctgctctccactgtgtgaggatacaacaggaagacagccatctggtgaggaagagagggccctcgccagataccggacctgctgacaccttgatcttggacttcccatcttccaggaaggcctgacctcagttgttccagggtaaagaatttgggcagtgcccacacccacgctgttggataacatttcttcaccataccagtgagggtgaatgtgtacacgcccagcttcctgcctgttactctccacagtatgcgaagaatatccctgacttctagccctgtgcgccttcttttgtttctgctgttgctactaatagccttggagatcatggttggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaagg

SEQ ID NO: 175365 - DNA, 2099 bp, Homo sapiens
  Payload ID: 14442
  Gene Symbol: RAET1E
  Gene Name: retinoic acid early transcript 1E
  Uniprot ID: Q8TD07
  ENST ID: ENST00000532335
  CDS Start-End: 348-986
cctaattctcaaggtgatgctatttaggaagtcataactcatgtgagtggagccatgtgggattaagaagtgataggagagcttgctgtctgtctctgctctccactgtgtgaggatacaacaggaagacagccatctggtgaggaagagagggccctcgccagataccggacctgctgacaccttgatcttggacttcccatcttccaggaaggcctgacctcagttgttccagggtaaagaatttgggcagtgcccacacccacgctgttggataacatttcttcaccataccagtgagggtgaatgtgtacacgcccagcttcctgcctgttactctccacagtatgcgaagaatatccctgacttctagccctgtgcgccttcttttgtttctgctgttgctactaatagccttggagatcatggttggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaaggtatatgccaccagcacttggggagaattgacccaaacgctgggagaagtggggcgagacctcaggatgctcctttgtgacatcaaaccccagataaagaccagtgatccttccactctgcaagtcgagatgttttgtcaacgtgaagcagaacggtgcactggtgcatcctggcagttcgccaccaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacaggcagaagatccacctagaggtgataccacggcggcgcagagttgttcacctgtggtcctcgatcgctgacagccttggctcccactgctgtgtgttccctgagtcaagtggaggcggagcctgcaatgagcggagatcgcgcctctgcattccagtcttggcaacagagcaagactccgtctcaaaaaaaaaaaattttttttcagtacatattttttaaaagatagggctgggcacagcagctcacatctataatcccaacactttgggaggcctaggcaggaggatcacttgagcccaggaatctgaagctgcagtgagcctttgctcgtgagattgtggacctatgatcctaccaccagcccacctggttctaacaccccctcctctatgtgtgagagggagagaagaaaagtgagggagaaaagagagataagcaaagaacagagaggaaaaatggaaaataagaggaaattgggggaattaaacagaggggagggcatggatccccgggagttagaagagtagcagcttgtggattactacgcagtggaggaagaagagttgttggaaattatttgagaggtagtataatcatttgtgaggcagttttctgcattcaccatttctcacagactaagttactcataagcaaacgtgcaattcacattacactgaaattcttccctaatacatcatttgcattggaataaagtacggttttcaaacaacctgatatagcagaactgactgtataaattatgtgagcacagtgcaagtaattctttgtttgtttgtttgtttttttgagacagagtctcactctatctcccaggctggagtgtagtggtgcgatcccggctcactgcaacctcgatctcccaggctcaagcgattcccctgcctcagcctcctgagtagctgggattacaggcatgagccaccacgcccggctaatttttgtatttttagtagagacggggtttcaccctgttggccaggctggtctcgaactacggacctcaggtgatctgcccccctcagcctctcaaagtgctgggattatagcatgagccactgagcccagacacaagtagttctttctgataaacactttaacactgaatgca

SEQ ID NO: 175366 - DNA, 1107 bp, Homo sapiens
  Payload ID: 14443
  Gene Symbol: RAET1G
  Gene Name: retinoic acid early transcript 1G
  Uniprot ID: Q6H3X3
  ENST ID: ENST00000367360
  CDS Start-End: 69-1073
cctgcgagccgccaggtgatccacgggctgggcttcgcttctgctgtcccctgcgatccaactccccaatggcagcggccgccagccccgcgttccttctacgcctcccgcttctgctcctgctgtccagctggtgcaggaccgggctggccgaccctcactctctttgctatgacatcaccgtcatccctaagttcagacctggaccacggtggtgtgcggttcaaggccaggtggatgaaaagacttttcttcactatgactgtggcagcaagacagtcacacccgtcagtcccctggggaagaaactaaatgtcacaacggcctggaaagcacagaacccagtactgagagaggtggtggacatacttacagagcaactgcttgacattcagctggagaattacatacccaaggaacccctcaccctgcaggccaggatgtcttgtgagcagaaagccgaaggacacggcagtggatcttggcagctcagtttcgatggacagatcttcctcctctttgactcagaaaacagaatgtggacaacggttcatcctggagccagaaagatgaaagaaaagtgggagaatgacaaggatatgaccatgtccttccattacatctcaatgggagactgcacaggatggcttgaggacttcttgatgggcatggacagcaccctggagccaagtgcaggagcaccacccaccatgtcctcaggcacagcccaacccagggccacggccaccaccctcatcctttgctgcctcctcatcatgtgtctcctcatatgctccaggcacagtctgacccaaagccatggccaccaccctcagtccctgcagcctcctcctcatcctcccctgcttcatcctacctggctgctgaggagagtcctttggagtgacagctaccaaatagcgaagcgccccttgtctggtggacacgtgactcgcgtgactttacctatcattggagacgactcacactccttaccctgccctcttgccttgtatacaataaataacggcgcagccaggtattcggagccactacaggtctccatatcttgatggttccctgggcccagctgtcttttcttccgtc

SEQ ID NO: 175367 - DNA, 904 bp, Homo sapiens
  Payload ID: 14443
  Gene Symbol: RAET1G
  Gene Name: retinoic acid early transcript 1G
  Uniprot ID: Q6H3X3
  ENST ID: ENST00000367361
  CDS Start-End: 1-642
atggcagcggccgccagccccgcgttccttctacgcctcccgcttctgctcctgctgtccagctggtgcaggaccgggctggccgaccctcactctctttgctatgacatcaccgtcatccctaagttcagacctggaccacggtggtgtgcggttcaaggccaggtggatgaaaagacttttcttcactatgactgtggcagcaagacagtcacacccgtcagtcccctggggaagaaactaaatgtcacaacggcctggaaagcacagaacccagtactgagagaggtggtggacatacttacagagcaactgcttgacattcagctggagaattacatacccaaggaacccctcaccctgcaggccaggatgtcttgtgagcagaaagccgaaggacacggcagtggatcttggcagctcagtttcgatggacagatcttcctcctctttgactcagaaaacagaatgtggacaacggttcatcctggagccagaaagatgaaagaaaagtgggagaatgacaaggatatgaccatgtccttccattacatctcaatgggagactgcacaggatggcttgaggacttcttgatgggcatggacagcaccctggagccaagtgcaggaggcacagtctgacccaaagccatggccaccaccctcagtccctgcagcctcctcctcatcctcccctgcttcatcctacctggctgctgaggagagtcctttggagtgacagctaccaaatagcgaagcgccccttgtctggtggacacgtgactcgcgtgactttacctatcattggagacgactcacactccttaccctgccctcttgccttgtatacaataaataacggcgcagccaggtattcggagccactacaggtctccatatcttg

SEQ ID NO: 175368 - DNA, 1078 bp, Homo sapiens
  Payload ID: 14443
  Gene Symbol: RAET1G
  Gene Name: retinoic acid early transcript 1G
  ENST ID: ENST00000479265
  CDS Start-End: 112-777
actggagtttagggctgcattcagacgggctgcattcagacagcctgcgagccgccaggtgatccacgggctgggcttcgcttctgctgtcccctgcgatccaactccccaatggcagcggccgccagccccgcgttccttctacgcctcccgcttctgctcctgctgtccagctggtgcaggaccgggctggccgaccctcactctctttgctatgacatcaccgtcatccctaagttcagacctggaccacggtggtgtgcggttcaaggccaggtggatgaaaagacttttcttcactatgactgtggcagcaagacagtcacacccgtcagtcccctggggaagaaactaaatgtcacaacggcctggaaagcacagaacccagtactgagagaggtggtggacatacttacagagcaactgcttgacattcagctggagaattacatacccaaggaacccctcaccctgcaggccaggatgtcttgtgagcagaaagccgaaggacacggcagtggatcttggcagctcagtttcgatggacagatcttcctcctctttgactcagaaaacagaatgtggacaacggttcatcctggagccagaaagatgaaagaaaagtgggagaatgacaaggatatgaccatgtccttccattacatctcaatgggagactgcacaggatggcttgaggacttcttgatgggcatggacagcaccctggagccaagtgcaggaggtaacaggagaaaaagaaatggggatctccaatgagatcagaaatggggatctcaagaaactaattcttgagttcagcttcaatcatcccagtgtacacgtttatgttaaaatgacctcctcgtggggtgctcctcctgggggtgctggcgtgcctgtgctctcccaccctcctcttccttctccctcctgactcctcttcctcactgcacttgcttctgttccccacactgtggatttctcaccagcctcgaaactgcaggtgtcactattttcaggcctttctccttagtgttccctcttgagaatcacttttcctttcctcctctggtctgtt

SEQ ID NO: 175369 - DNA, 802 bp, Homo sapiens
  Payload ID: 14444
  Gene Symbol: RAET1L
  Gene Name: retinoic acid early transcript 1L
  Uniprot ID: Q5VY80
  ENST ID: ENST00000286380
  CDS Start-End: 62-802
gatttcatcttccaggatccaccttgattaaatctcttgtccccagccctcctggtccccaatggcagcagccgccatcccagctttgcttctgtgcctcccgcttctgttcctgctgttcggctggtcccgggctaggcgagacgaccctcactctctttgctatgacatcaccgtcatccctaagttcagacctggaccacggtggtgtgcggttcaaggccaggtggatgaaaagacttttcttcactatgactgtggcaacaagacagtcacacccgtcagtcccctggggaagaaactaaatgtcacaatggcctggaaagcacagaacccagtactgagagaggtggtggacatacttacagagcaactgcttgacattcagctggagaattacacacccaaggaacccctcaccctgcaggcaaggatgtcttgtgagcagaaagctgaaggacacagcagtggatcttggcagttcagtatcgatggacagaccttcctactctttgactcagagaagagaatgtggacaacggttcatcctggagccagaaagatgaaagaaaagtgggagaatgacaaggatgtggccatgtccttccattacatctcaatgggagactgcataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctga

SEQ ID NO: 175370 - DNA, 1285 bp, Homo sapiens
  Payload ID: 14444
  Gene Symbol: RAET1L
  Gene Name: retinoic acid early transcript 1L
  Uniprot ID: Q5VY80
  ENST ID: ENST00000367341
  CDS Start-End: 1-741
atggcagcagccgccatcccagctttgcttctgtgcctcccgcttctgttcctgctgttcggctggtcccgggctaggcgagacgaccctcactctctttgctatgacatcaccgtcatccctaagttcagacctggaccacggtggtgtgcggttcaaggccaggtggatgaaaagacttttcttcactatgactgtggcaacaagacagtcacacccgtcagtcccctggggaagaaactaaatgtcacaatggcctggaaagcacagaacccagtactgagagaggtggtggacatacttacagagcaactgcttgacattcagctggagaattacacacccaaggaacccctcaccctgcaggcaaggatgtcttgtgagcagaaagctgaaggacacagcagtggatcttggcagttcagtatcgatggacagaccttcctactctttgactcagagaagagaatgtggacaacggttcatcctggagccagaaagatgaaagaaaagtgggagaatgacaaggatgtggccatgtccttccattacatctcaatgggagactgcataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagatgataccaaaaagcccctgtgagcacggtcttgatcaacctcgcccttctgtctggccagctgcccaccacctacggtgtatgtccagcagcctccagcagatgatgatgacaccatggacccaatagctcattcactgccttgattccttttgccaacaatttaaccagtgattattcctaacatattatgcaattttctcttggtgctacctgatggaattcctgcacttaaagttctggctgactaaacaagatatgtcaacattttctttcttctctttttgtttggaaaatcaagtacttctttgaatgatgatttctttctttcattactgacatgattgtcagtaaaacaatcatgttagacttcagacctccagggattctttccatgtcctgaaagagaattgtttaattatttaataagaaaaaaatttatattaatgattgtttcctttagtaatttattgctgtgtactgatatttaaataaagagttatatttcccaaaaa

SEQ ID NO: 175371 - DNA, 7662 bp, Homo sapiens
  Payload ID: 14445
  Gene Symbol: RAI1
  Gene Name: retinoic acid induced 1
  Uniprot ID: Q7Z5J4
  ENST ID: ENST00000353383
  CDS Start-End: 470-6190
cccgcggacaccaggcaggcccggccgggtgcgcggccaaggcccgctccccgcgtccccgggcgccgcccccgcccgcggctgggctccgagagacgagtgggagagcgagtgcagcgagggcgagaggcgagccgagcaggccgccctgcccgcggccctagcgccggcgcgaggagggggcgccgcggcccaccctccttcctgcctggccgcgggccggccgggccgccgcgccccgacccccatggccacccaggcctccgggccgcgaagtcgcagcgccagacccaaggcccccgagtgagcgcgggcgccgaggatctcatctggccaccgcgttctggaagaggcgagagggagagcgtgcgcgagaggagagagacggcgggggaaagggagacggcgagacgcgcagcgccggcgcccgggagacccaggaggagcccgcagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatgatgtgttccagctgccaagaagccggggccaccattgggtgctgccacaaaggatgcctccacacctaccactacccgtgtgccagcgatgcaggttgcatattcatcgaagagaacttttctttgaaatgtcccaaacataagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttctgagagcgggctaggccggcactggagaggccggagcctttggaacaaaccgtgcggaacgcgtccaggggccttcccgcccagcctttgccagatctctcgtgcggttcgggcaaagccggggtagacctgggctatgctcagttaggggttgcgggatccccgagtgtgggcgggactgggacaccctttggcctctgtttgtcccctttccagtcctccaccccacccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaaaaaaaaaaaaaaaagtcaataaagatacaacgattgttttggaaaa

SEQ ID NO: 175372 - DNA, 2928 bp, Homo sapiens
  Payload ID: 14445
  Gene Symbol: RAI1
  Gene Name: retinoic acid induced 1
  ENST ID: ENST00000395774
  CDS Start-End: 101-2928
ctgagatttagccgtgcgatgcccgcgcaggggcgggggccgcgggccaggggaggcgctcagagtccggagccgccgagcgagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttga

SEQ ID NO: 175373 - DNA, 570 bp, Homo sapiens
  Payload ID: 14445
  Gene Symbol: RAI1
  Gene Name: retinoic acid induced 1
  ENST ID: ENST00000471135
  CDS Start-End: 376-570
cgccccacagacggcggcgcagcccgccgcccttttcgaggccggccccccctctcacgcgccttgaaggcaagccggtatattcggggcccaggagcaaggaaaagtggccttttgcgtgacacagaagtggacacatcattctgatctcagggcaggctcagccccataactctggcaaaagctctcacaagcaaaagccttggagaggaggagaatgtatcaaggatctcatctggccaccgcgttctggaagaggcgagagggagagcgtgcgcgagaggagagagacggcgggggaaagggagacggcgagacgcgcagcgccggcgcccgggagacccaggaggagcccgcagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacg

SEQ ID NO: 175374 - DNA, 489 bp, Homo sapiens
  Payload ID: 14445
  Gene Symbol: RAI1
  Gene Name: retinoic acid induced 1
  ENST ID: ENST00000583166
  CDS Start-End: 1-469
ggcagagcccggcggggaggcccaggagcactgggtgcatgaggcctgtgccgtgtggaccggcggcgtctacctggtggccgggaagctctttgggctgcaggaggccatgaaggtggccgtggacatgatgtgttccagctgccaagaagccggggccaccattgggtgctgccacaaaggatgcctccacacctaccactacccgtgtgccagcgatgcaggtacgagcccgcccaggaacaggagggcattggagcccatccaagcagtccagggggaccctccctgggcacagctccccaaacccaggccccatctcactcttcagtttccctcctctcttgccccagcaattcttttatccttctgtctgcctagacctctgctgggcaatgccagggacatggaaatgaggcattccccaggcacctgcttgaggagtgcccagagcagtgagggaagatagaagcataaattacaatgtgg

SEQ ID NO: 175375 - DNA, 5092 bp, Homo sapiens
  Payload ID: 14446
  Gene Symbol: RAI14
  Gene Name: retinoic acid induced 14
  Uniprot ID: Q9P0K7
  ENST ID: ENST00000265109
  CDS Start-End: 288-3230
atccaggtcggcgggggccggcgcccggcggccacgtggtggtgctgccgctgcccccgccccgccggcctagcccgggagctcggcgcccactgacccccgcagcgggggaggaggagggactgcggcgcaggaagccgagcaggaagcgagcccggcggccgcgttttcctggggaagcggcgggcggggtggagcagccagctgggtccggggagcgccgccgccgcctcgatggggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgcatttctggtgttgatt

SEQ ID NO: 175376 - DNA, 5064 bp, Homo sapiens
  Payload ID: 14446
  Gene Symbol: RAI14
  Gene Name: retinoic acid induced 14
  Uniprot ID: Q9P0K7
  ENST ID: ENST00000428746
  CDS Start-End: 276-3218
gatggggtgagtgcgcggcacggagttgggaggctcccggcgcggggtcccgggctcgtgtccccgcctttgtgtctggagctcgggcgcgggaggcgctggggacggcgcccgggcggagcggctgagcgggctgcagccggggtcccgccacctctccctggtccaccgccggcagcccactgtctgcggagagcagatctggggacaagaggaaggagaggaaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgc

SEQ ID NO: 175377 - DNA, 542 bp, Homo sapiens
  Payload ID: 14446
  Gene Symbol: RAI14
  Gene Name: retinoic acid induced 14
  ENST ID: ENST00000514873
  CDS Start-End: 164-542
gagatgcaccctggagtctgcgccgggtcccacctgtttcgccccgcgcggcgcctcgctgcccccgcgtcggtgctgctgagcccaatccgcctcccggctgaacttggaggaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcag

SEQ ID NO: 175378 - DNA, 548 bp, Homo sapiens
  Payload ID: 14446
  Gene Symbol: RAI14
  Gene Name: retinoic acid induced 14
  ENST ID: ENST00000513974
  CDS Start-End: 170-548
agcagccagctgggtccggggagcgccgccgccgcctcgatggggtaacctctaatgtgaagttagcgcacacagttctcaagcatgtttggaactacactgtatccacaaaaaaatacatgtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcag

SEQ ID NO: 175379 - DNA, 542 bp, Homo sapiens
  Payload ID: 14446
  Gene Symbol: RAI14
  Gene Name: retinoic acid induced 14
  ENST ID: ENST00000512305
  CDS Start-End: 222-542
aaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcag

SEQ ID NO: 175380 - DNA, 2941 bp, Homo sapiens
  Payload ID: 14446
  Gene Symbol: RAI14
  Gene Name: retinoic acid induced 14
  Uniprot ID: Q9P0K7
  ENST ID: ENST00000512629
  CDS Start-End: 86-2941
agctgggtccggggagcgccgccgccgcctcgatggggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaa

SEQ ID NO: 175381 - DNA, 630 bp, Homo sapiens
  Payload ID: 14446
  Gene Symbol: RAI14
  Gene Name: retinoic acid induced 14
  ENST ID: ENST00000504052
  CDS Start-End: 289-630
aagattgaaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtagcaacaagctcatgaagaaggcattcagtggcttgcactccccacccatcctctcaagtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagt

SEQ ID NO: 175382 - DNA, 3339 bp, Homo sapiens
  Payload ID: 14446
  Gene Symbol: RAI14
  Gene Name: retinoic acid induced 14
  Uniprot ID: Q9P0K7
  ENST ID: ENST00000503673
  CDS Start-End: 357-3299
actcccgctgaggctgggaagattgaaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtagcaacaagctcatgaagaaggcattcagtggcttgcactccccacccatcctctcaactacatgcgaagttttcacatcttgtacatttccaaatttaatgaaaaaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtc

SEQ ID NO: 175383 - DNA, 3091 bp, Homo sapiens
  Payload ID: 14446
  Gene Symbol: RAI14
  Gene Name: retinoic acid induced 14
  Uniprot ID: Q9P0K7
  ENST ID: ENST00000506376
  CDS Start-End: 153-3071
gggagaaaaacatagcagaggggttgtacacgataatatttttttaaaaggtcaccccataaacccttctatgatcccagtcttgtattagctgcattccagatactttgagcagagttgtggagtgggagaaattaatggaagggaattagatggaagccaagaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggac

SEQ ID NO: 175384 - DNA, 1387 bp, Homo sapiens
  Payload ID: 14446
  Gene Symbol: RAI14
  Gene Name: retinoic acid induced 14
  ENST ID: ENST00000508777
  CDS Start-End: 308-508
atgcatctgtcactcccgctgaggctgggaagattgaaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggagctacatgcgaagttttcacatcttgtacatttccaaatttaatgaaaaaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacatttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagt

SEQ ID NO: 175385 - DNA, 575 bp, Homo sapiens
  Payload ID: 14446
  Gene Symbol: RAI14
  Gene Name: retinoic acid induced 14
  ENST ID: ENST00000514036
  CDS Start-End: 263-575
atggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggagctacatgcgaagttttcacatcttgtacatttccaaatttaatgaaaaaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagc

SEQ ID NO: 175386 - DNA, 557 bp, Homo sapiens
  Payload ID: 14446
  Gene Symbol: RAI14
  Gene Name: retinoic acid induced 14
  ENST ID: ENST00000510319
  CDS Start-End: 124-294
cgttttcctggggaagcggcgggcggggtggagcagccagctgggtccggggagcgccgccgccgcctcgatggggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgcgtaagctgaaacactgtttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcg

SEQ ID NO: 175387 - DNA, 660 bp, Homo sapiens
  Payload ID: 14446
  Gene Symbol: RAI14
  Gene Name: retinoic acid induced 14
  ENST ID: ENST00000514527
  CDS Start-End: 243-660
cgcgttttcctggggaagcggcgggcggggtggagcagccagctgggtccggggagcgccgccgccgcctcgatggggatctcgctctgtcccttaggctggagtgcagtggtgcaatcttagctcaccgcagccttgacctcctgggctcaagcagtcctcccaccttagcctccctggagctggcactacaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcg

SEQ ID NO: 175388 - DNA, 554 bp, Homo sapiens
  Payload ID: 14446
  Gene Symbol: RAI14
  Gene Name: retinoic acid induced 14
  ENST ID: ENST00000512625
  CDS Start-End: 105-554
aaggatgcagcgtttcagttaagaggaatagatgaagagatctattgtacaacatggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttg

SEQ ID NO: 175389 - DNA, 522 bp, Homo sapiens
  Payload ID: 14446
  Gene Symbol: RAI14
  Gene Name: retinoic acid induced 14
  ENST ID: ENST00000515448
  CDS Start-End: 160-222
ctacttctgtgaaatgaggcacttagactagatgagcaatcttgacttttgaagggtggcaactaccttgtagaatccagtgaaaactcagaaccttcctccctgaaaaatgtgttgaaaagtctcctctagagctttggaaggctgaatgcactaaacatgaagagcttgaaagcgaagttcaggaagagtgacgaatttgaaatctgtaaagaactctaacattggaaatgcctgataacatacatctgcagttatttgtggcaaaagacaaggcaaataggcaaatattcggtattataaaaaatgcacagatttcaaaggacaagtataggtggatttacatgcctacatcttttgagaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacg

SEQ ID NO: 175390 - DNA, 562 bp, Homo sapiens
  Payload ID: 14446
  Gene Symbol: RAI14
  Gene Name: retinoic acid induced 14
  ENST ID: ENST00000503222
  CDS Start-End: 131-301
agatgagcaatcttgacttttgaagggtggcaactaccttgtagaatccagtgaaaactcagaaccttcctccctgaaaaatgtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgcgtaagctgaaacactgtttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctg

SEQ ID NO: 175391 - DNA, 579 bp, Homo sapiens
  Payload ID: 14446
  Gene Symbol: RAI14
  Gene Name: retinoic acid induced 14
  ENST ID: ENST00000508315
  CDS Start-End: 164-539
gttgctacttctgtgaaatgaggcacttagactagatgagcaatcttgacttttgaagggtggcaactaccttgtagaatccagtgaaaactcagaaccttcctccctgaaaaatgtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctg

SEQ ID NO: 175392 - DNA, 3486 bp, Homo sapiens
  Payload ID: 14446
  Gene Symbol: RAI14
  Gene Name: retinoic acid induced 14
  Uniprot ID: Q9P0K7
  ENST ID: ENST00000515799
  CDS Start-End: 493-3444
ggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtagcaacaagctcatgaagaaggcattcagtggcttgcactccccacccatcctctcaactacatgcgaagttttcacatcttgtacatttccaaatttaatgaaaaaggtgttgaaaagtctcctctagagctttggaaggctgaatgcactaaacatgaagagcttgaaagcgaagttcaggaagagtgacgtaaattaaataaaactcatagagtgcaaagagacttcgacaaagacagaaaactagctgttggccagagtgaaagtcctggtcatccgacttccgagaaacctccttcaacctcatcgtctgctggctgtatgttatgcagcctacatatctcccgtggctttcagctaaggagaaaaagaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctt

SEQ ID NO: 175393 - DNA, 2317 bp, Homo sapiens
  Payload ID: 14447
  Gene Symbol: RAI2
  Gene Name: retinoic acid induced 2
  Uniprot ID: Q9Y5P3
  ENST ID: ENST00000331511
  CDS Start-End: 358-1950
agcgactcggtgacagcggcgacggcggctcccaccgcggcgcacccccttcaggcggccggcggcgaggccagaccggagagttccagcacactcgaccaccccgcggcttcctggaggcggcggccgcgattgcgaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 175394 - DNA, 2377 bp, Homo sapiens
  Payload ID: 14447
  Gene Symbol: RAI2
  Gene Name: retinoic acid induced 2
  Uniprot ID: Q9Y5P3
  ENST ID: ENST00000360011
  CDS Start-End: 418-2010
ggcaccgcaccgggcagtctccggatctgccgttctgccccggcccggaaaacccggcgccttccaggcccttcgaaagatggattctgttgacgtatctggcggccctggcgagcctggtggaaagttgggttttgccagattgcgccgggctcctctttgtgacgcgcggccagccccgcatcccccccggagccgggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 175395 - DNA, 2037 bp, Homo sapiens
  Payload ID: 14447
  Gene Symbol: RAI2
  Gene Name: retinoic acid induced 2
  Uniprot ID: Q9Y5P3
  ENST ID: ENST00000415486
  CDS Start-End: 226-1668
acacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcactaa

SEQ ID NO: 175396 - DNA, 2224 bp, Homo sapiens
  Payload ID: 14447
  Gene Symbol: RAI2
  Gene Name: retinoic acid induced 2
  Uniprot ID: Q9Y5P3
  ENST ID: ENST00000451717
  CDS Start-End: 265-1857
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 175397 - DNA, 2421 bp, Homo sapiens
  Payload ID: 14447
  Gene Symbol: RAI2
  Gene Name: retinoic acid induced 2
  Uniprot ID: Q9Y5P3
  ENST ID: ENST00000545871
  CDS Start-End: 462-2054
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgagcaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 175398 - DNA, 463 bp, Homo sapiens
  Payload ID: 14447
  Gene Symbol: RAI2
  Gene Name: retinoic acid induced 2
  ENST ID: ENST00000509491
  CDS Start-End: 219-463
gcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctgcccctgtgcctcggggagagcccagtggtgatgcccattcacatgcaggtggagggaagctccgcaccagagctcaatccgaatggcaatgccacctacgtcatgaccac

SEQ ID NO: 175399 - DNA, 1952 bp, Homo sapiens
  Payload ID: 14448
  Gene Symbol: RARRES1
  Gene Name: retinoic acid receptor responder (tazarotene induced) 1
  Uniprot ID: P49788
  ENST ID: ENST00000237696
  CDS Start-End: 282-1166
gaccctctcccgccgcggcctgggccagaagcacccggccctgcgctgcggaggcgatgccgcatcctagcactaagcccgggcagcggggaggggcagagagaacccaggggctgcgggaaacgtggaaaaggagtggccccatggggacccgggctcgctacagaccttcgccctgggggcggaggggaggggcccaccacggccttatttccgcgagcgccggcactgcccgctccgagcccgtgtctgtcgggtgccgagccaactttcctgcgtccatgcagccccgccggcaacggctgcctgctccctggtccgggcccaggggcccgcgccccaccgccccgctgctcgcgctgctgctgttgctcgccccggtggcggcgcccgcggggtccggggaccccgacgaccctgggcagcctcaggatgctggggtcccgcgcaggctcctgcagcaggcggcgcgcgcggcgcttcacttcttcaacttccggtccggctcgcccagcgcgctacgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaaataatgaaatgtgttgaatgttctcgtgaagatttgtatacaaaggaaaaatttgtgctaaactggaattaaatgaaatggtaatattgcttaacttaaattttacaaataatagaacgtctgtctcaccagataaagctgtctgcaaacatgcatcaaaagaaacactgatgtaactgaaagtatattaaatatttacaattttcatttacaaggacaa

SEQ ID NO: 175400 - DNA, 839 bp, Homo sapiens
  Payload ID: 14448
  Gene Symbol: RARRES1
  Gene Name: retinoic acid receptor responder (tazarotene induced) 1
  Uniprot ID: P49788
  ENST ID: ENST00000479756
  CDS Start-End: 28-714
gggtgccgagccaactttcctgcgtccatgcagccccgccggcaacggctgcctgctccctggtccgggcccaggggcccgcgccccaccgccccgctgctcgcgctgctgctgttgctcgccccggtggcggcgcccgcggggtccggggaccccgacgaccctgggcagcctcaggatgctggggtcccgcgcaggctcctgcagcaggcggcgcgcgcggcgcttcacttcttcaacttccggtccggctcgcccagcgcgctacgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtgggtaagaaaaacctgaaaattaacttgtgccacaagagttacaatcaaagtggtctccttagactgaattcatgcgaacttctaatttcatatcaagagttgtaatcacatttatttcaataaatatgtgagttcctgcaa

SEQ ID NO: 175401 - DNA, 740 bp, Homo sapiens
  Payload ID: 14449
  Gene Symbol: RARRES2
  Gene Name: retinoic acid receptor responder (tazarotene induced) 2
  Uniprot ID: Q99969
  ENST ID: ENST00000223271
  CDS Start-End: 118-609
gccgccccgcgagaagaagagcgggaagaggcggacagcgaggccaagatttcagctgcgggacggtcaggggagacctccaggcgcagggaaggacggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagatgcgtggtgcctccaggaccgctgcgggtggtaaccagtggaagaccccagcccccagggagaggaacccgttctatccccagccatgataataaagctgctctcccagctgcctctc

SEQ ID NO: 175402 - DNA, 583 bp, Homo sapiens
  Payload ID: 14449
  Gene Symbol: RARRES2
  Gene Name: retinoic acid receptor responder (tazarotene induced) 2
  ENST ID: ENST00000467793
  CDS Start-End: 106-583
gaagaagagcgggaagaggcggacagcgaggccaagatttcagctgcgggacggtcaggggagacctccaggcgcagggaaggacggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcggagatgcgtggtgcctccaggaccgctgcgggtggtaaccagtggaagaccccagcccccagggagaggaacccgttctatccccagccatgataataaagctg

SEQ ID NO: 175403 - DNA, 1618 bp, Homo sapiens
  Payload ID: 14449
  Gene Symbol: RARRES2
  Gene Name: retinoic acid receptor responder (tazarotene induced) 2
  Uniprot ID: Q99969
  ENST ID: ENST00000466675
  CDS Start-End: 1035-1526
cggacagcgaggccaagatttcagctgcgggacggtcaggggagacctccaggcgcagggaaggacgtgaggaggggaagcgggctggggcggcagccgggcggaggggcagctgcgcaggcggaatgaggaacgcctttgctctaaggcgaccaccctggcagctcttcactgaggggcctcggtttccacatctgtcgctctccggtcccaagaccaccaggaccgacggggctctccgggagggtcagcccctccggtggccccagtcatgcatcaggggacggatcagaagggctaggaagaggggtcgtggggaaggccccagaaaaaagaggaaggagggaagattttgcctgaagcgggaaagccaagggctgggcggcgcgagacccccattcctagcgactggggctggctggtggcccgcggcagcccccgcgccgggaggattaggcctcccgccgctcccacccgtccggaccctcccacgtgtttaggtcctcccaaaagtattcggcctccggcccctgccccttcccccggctggcctggacctcggggacgtggggggaaccccgtgggagcagggggattctggacggggagggagtagcggttggggagaaggctgagcggggaaaggagagaggggctccggggacggcagggaggagagtgggtcgtgccggagacccagggagagacacaatgggcaagattaggggtgtagggtgggagtgcgaactgactgattcctagcgtgggcagggaactttgctaaaactgcaggccccagggaacagcgcgggcagggtgggagggaacggagagggccaggcggaccctaaggtcaatttggagaaagggccatttccaggctccttcacctgtgcccagcgttctacaggcctggaccccgcccccgctccccaccctccccccagagcagggcgcgggaggaggcggctcgggctggctcggagagctgaggggcgcacacccgcttcgcagggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagatgcgtggtgcctccaggaccgctgcgggtggtaaccagtggaagaccccagcccccagggagaggaacccgttctatcc

SEQ ID NO: 175404 - DNA, 563 bp, Homo sapiens
  Payload ID: 14449
  Gene Symbol: RARRES2
  Gene Name: retinoic acid receptor responder (tazarotene induced) 2
  Uniprot ID: Q99969
  ENST ID: ENST00000482669
  CDS Start-End: 72-563
agaagagcgggaagaggcggacagcgaggccaagatttcagctgcgggacgggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaa

SEQ ID NO: 175405 - DNA, 749 bp, Homo sapiens
  Payload ID: 14450
  Gene Symbol: RARRES3
  Gene Name: retinoic acid receptor responder (tazarotene induced) 3
  Uniprot ID: Q9UL19
  ENST ID: ENST00000255688
  CDS Start-End: 49-543
agctgatccacaaacaagaggagcaccagacctcctcttggcttcgagatggcttcgccacaccaagagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtggaaaaggccaaggttgaagtcggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttcagaaa

SEQ ID NO: 175406 - DNA, 696 bp, Homo sapiens
  Payload ID: 14450
  Gene Symbol: RARRES3
  Gene Name: retinoic acid receptor responder (tazarotene induced) 3
  ENST ID: ENST00000354445
  CDS Start-End: 1-495
atggggctgcctgaaccaaagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtggaaaaggccaaggttgaagtcggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttc

SEQ ID NO: 175407 - DNA, 938 bp, Homo sapiens
  Payload ID: 14450
  Gene Symbol: RARRES3
  Gene Name: retinoic acid receptor responder (tazarotene induced) 3
  Uniprot ID: Q9UL19
  ENST ID: ENST00000439013
  CDS Start-End: 54-524
ataaaagctgatccacaaacaagaggagcaccagacctcctcttggcttcgagatggcttcgccacaccaagagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtaaggacctctctggataatccatctccctctgcttggggctggactcacggggctgtgcagccaggcgatcactgtgaatgatgcaaatgcagcctcttagagacctgctggctgagagtcaggacctctgagctccaatgccagatctgcttctaatccacagagggtctttggacagttcccttccccccaggcctctccatgtgcagaggagggggtggatggaggagctctgaggatccttcccctctaaaacctatcctgaaaatggctcctgaagttctgggggtcatcaggagaatctgggccaacccaggacaatgacaggtcctgcaaccccccaaagagtactcaggcaagggacgctcagggtccgtggacctgtgtaagagctcaaggacatttgtgtgtaagatctgggcacagcctccatcccttgccccttcacagtctttcacatttgttgccccaaaacactcaactaataagtggcag

SEQ ID NO: 175408 - DNA, 2414 bp, Homo sapiens
  Payload ID: 14451
  Gene Symbol: RARA
  Gene Name: retinoic acid receptor, alpha
  Uniprot ID: P10276
  ENST ID: ENST00000254066
  CDS Start-End: 456-1844
cagaagcaggggggaatcctgaatcgagctgagagggcttccccggttctcctgggaaccccatcggccccctgccagcacacacctgagcagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcaca

SEQ ID NO: 175409 - DNA, 2285 bp, Homo sapiens
  Payload ID: 14451
  Gene Symbol: RARA
  Gene Name: retinoic acid receptor, alpha
  Uniprot ID: P10276
  ENST ID: ENST00000394081
  CDS Start-End: 343-1716
agccgctgtactctgcctcggacgccacgagactctagacgggagtcccctcgaggtgaagccgctgagttcccgggccccgccaggcttccctgggagagccgacggaccccccctcccagcacacacaacttccctgcttttcaccgggactggcggagcggccggcggacttagacgcggggacttcagggcagggggcgccccctgcccgggtcaccagtcggggcgaggggacgtctcctctcccccagctgctctgctcggatggcgccgccggctgagtgacgggggcggcgcgcaggacttcccagctcggacctcttgccttcgaggggaaagatgtacgagagtgtagaagtggggggtcccacccctaatcccttcctagtggtggatttttataaccagaaccgggcctgtttgctcccagagaaggggctccccgccccgggtccgtactccaccccgctccggactccgctttggaatggctcaaaccactccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcac

SEQ ID NO: 175410 - DNA, 2008 bp, Homo sapiens
  Payload ID: 14451
  Gene Symbol: RARA
  Gene Name: retinoic acid receptor, alpha
  ENST ID: ENST00000394086
  CDS Start-End: 3-1439
acatgatgtcacagacaatgacacaagccggtgtctcattccgacacagcgtccgagctgcacaatgtcacacccgggtgccaaacacttggccccgcgcgacccggccctacgcctcctgccgccgctctccgcgtctccgggggaggtggcccggttcggccgggcagggggctggcgggcgagccccgcgggcgggctggcgagcgggtgatgtcacgggcagcgccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcac

SEQ ID NO: 175411 - DNA, 2024 bp, Homo sapiens
  Payload ID: 14451
  Gene Symbol: RARA
  Gene Name: retinoic acid receptor, alpha
  Uniprot ID: P10276
  ENST ID: ENST00000394089
  CDS Start-End: 531-1919
gtgactcgctatggccgctgccatcgccccgcgcccctgagccgcggccccctggacggctcctctcccgggaccccgcaccctgatgccgagcagcaccagggcgccgggttagggcagacgctgtgctcgctggcaccccgaacgggttgcttcccccgctgcgagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctccc

SEQ ID NO: 175412 - DNA, 3041 bp, Homo sapiens
  Payload ID: 14451
  Gene Symbol: RARA
  Gene Name: retinoic acid receptor, alpha
  Uniprot ID: P10276
  ENST ID: ENST00000425707
  CDS Start-End: 527-1624
ctcgctatggccgctgccatcgccccgcgcccctgagccgcggccccctggacggctcctctcccgggaccccgcaccctgatgccgagcagcaccagggcgccgggttagggcagacgctgtgctcgctggcaccccgaacgggttgcttcccccgctgcgagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccactgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattcta

SEQ ID NO: 175413 - DNA, 813 bp, Homo sapiens
  Payload ID: 14451
  Gene Symbol: RARA
  Gene Name: retinoic acid receptor, alpha
  ENST ID: ENST00000475125
  CDS Start-End: 256-813
ctgggctaggggccttcttccgctgccgcggtacacccagagctacccccgcctctccccgggaggaggaaggacgccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctc

SEQ ID NO: 175414 - DNA, 733 bp, Homo sapiens
  Payload ID: 14451
  Gene Symbol: RARA
  Gene Name: retinoic acid receptor, alpha
  ENST ID: ENST00000577646
  CDS Start-End: 535-733
cccagaagcaggggggaatcctgaatcgagctgagagggcttccccggttctcctgggaaccccatcggccccctgccagcacacacctgagcaggtgtgtgactctggggtgtaacgcgtgggcagctagggatgctgatgctggagaagggatcctggcaccttctgaggcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagca

SEQ ID NO: 175415 - DNA, 3084 bp, Homo sapiens
  Payload ID: 14452
  Gene Symbol: RARB
  Gene Name: retinoic acid receptor, beta
  Uniprot ID: P10826
  ENST ID: ENST00000330688
  CDS Start-End: 422-1768
tctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaa

SEQ ID NO: 175416 - DNA, 1273 bp, Homo sapiens
  Payload ID: 14452
  Gene Symbol: RARB
  Gene Name: retinoic acid receptor, beta
  ENST ID: ENST00000383772
  CDS Start-End: 67-1273
ttggtttaagacctggagtgatgtgttcctgctccagagcacctttctttctgtgaggcccgaaacatgaccaccagcggccacgcatgtccggtcccagcagtgaacggacacatgactcactatccagccacaccctacccgttactctttccacctgtcatcggaggactttccctgcctcccctccatggccttcatggacatccgcctccgagtggatgcagcaccccgtcgccggcaacaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattc

SEQ ID NO: 175417 - DNA, 2590 bp, Homo sapiens
  Payload ID: 14452
  Gene Symbol: RARB
  Gene Name: retinoic acid receptor, beta
  Uniprot ID: P10826
  ENST ID: ENST00000458646
  CDS Start-End: 264-1274
agacaaacccaaaacatttatgtgcatagaaaaaaattctggaaggtcgtacacagtgaatttctctgagtgaaaagattgtggcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaa

SEQ ID NO: 175418 - DNA, 2775 bp, Homo sapiens
  Payload ID: 14452
  Gene Symbol: RARB
  Gene Name: retinoic acid receptor, beta
  Uniprot ID: P10826
  ENST ID: ENST00000437042
  CDS Start-End: 449-1459
gtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatgcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaa

SEQ ID NO: 175419 - DNA, 1836 bp, Homo sapiens
  Payload ID: 14453
  Gene Symbol: RARG
  Gene Name: retinoic acid receptor, gamma
  Uniprot ID: P13631
  ENST ID: ENST00000338561
  CDS Start-End: 160-1491
ctcttccccgcccaccccttacccgcatgcagcccagcgccctatgctagccctccccctccccccctgctggagcggggcgccgccgggggaggagggggaatcggctgcgggtccttggtgtttccagcacccagtttcccttcaagccgggtcgcgatgtacgactgtatggaaacgtttgccccgggtccgcgacggctgtacggggcggccgggcccggggccggcttgctgcgcagagccaccggcggctcctgtttcgccggacttgaatcttttgcctggccgcaacccgccagcctgcaatcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgcca

SEQ ID NO: 175420 - DNA, 2640 bp, Homo sapiens
  Payload ID: 14453
  Gene Symbol: RARG
  Gene Name: retinoic acid receptor, gamma
  Uniprot ID: P13631
  ENST ID: ENST00000394426
  CDS Start-End: 383-1531
aggttggggggggggtggggagggagaaaaagaaagaaaatattttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagcagctacggcccagttccctcaacctgacccagtatgtagaagccagtctctgcaggcggccagcggcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactcatg

SEQ ID NO: 175421 - DNA, 2959 bp, Homo sapiens
  Payload ID: 14453
  Gene Symbol: RARG
  Gene Name: retinoic acid receptor, gamma
  Uniprot ID: P13631
  ENST ID: ENST00000425354
  CDS Start-End: 489-1853
tggggggggggtggggagggagaaaaagaaagaaaatattttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagcagctacggcccagttccctcaacctgacccagtatgtagaagccagtctctgcaggcggccagcgggacttttggaggcccagtgggcaggccaggcagggcgggtacggagcctcccaggctggggcagtgggcatgggcaggggctgtggctgaagacctcgcccgcccactgcagaccccaggggactctcacaccgcagctgccatggccaccaataaggagcgactctttgcggctggtgccctggggcctggatctggctacccaggggcaggtttccccttcgccttcccaggggcactcagggggtctccgcctttcgagatgctgagccctagcttccggggcctgggccagcctgacctccccaaggagatggcctctctgtcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactc

SEQ ID NO: 175422 - DNA, 1779 bp, Homo sapiens
  Payload ID: 14453
  Gene Symbol: RARG
  Gene Name: retinoic acid receptor, gamma
  Uniprot ID: P13631
  ENST ID: ENST00000543726
  CDS Start-End: 198-1496
caagccccaccccccacccctccaggcttcgcttttaaaaaaggtctccccagtgctagctgccgaagcacccagataagagctggacggaggctaaagcggcagccccagcttcgcgccccgcccagtccctttcccctgctggggatcccccctcttccccgcccaccccttacccgcatgcagcccagcgccctatgctagccctccccctccccccctgctggagcggggcgccgccgggggaggagggggaatcggctgcgggtccttggtgtttccagcacccagtttcccttcaagccgggtcgcgatgtacgactgtatggaaacgtttgccccgggtccgcgacggctgtacggggcggccgggcccggggccggcttgctgcgcagagccaccggcggctcctgtttcgccggacttgaatcttttgcctggccgcaacccgccagcctgcaatggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccat

SEQ ID NO: 175423 - DNA, 944 bp, Homo sapiens
  Payload ID: 14453
  Gene Symbol: RARG
  Gene Name: retinoic acid receptor, gamma
  ENST ID: ENST00000550362
  CDS Start-End: 899-944
tcccagccacagttcctcctgccctcctctccagcctctccccttccaaatccaggcctaaaggtgggggacaactggcagccagggacccaggcgccctaactcctggagcttactccaggcaagatgacagggaagatgtctgtgagccctggcctcagcacccccagcaacagccactagtcaaccagtttgctcctgggaccaaaggactgaggtgggctaggggaagggagaggctacttggatctgcaggtgaaggctgagcaaagagtaagggcaggagcatctattctagatctggcatactcctgcccggccaatccagcactgggagggagtgggtaccgccccattgcctaccctggggaggcgccagagactggcctcgcaagagtcacagcctggccacagacaactcaactagtccccccaaaaggcagaaaggagaaaagtgccagagagaaaagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagcagctacggcccagttccctcaacctgacccagtatgtagaagccagtctctgcaggcggccagcgggacttttggaggcccagtgggcaggccaggcagggcgggtacggagcctcccaggctggggcagtgggcatgggcaggggctgtggctgaagacctcgcccgcccactgcagaccccaggggactctcacaccgcagctgccatggccaccaataaggagcgactctttgcggctggtgccctggggc

SEQ ID NO: 175424 - DNA, 555 bp, Homo sapiens
  Payload ID: 14453
  Gene Symbol: RARG
  Gene Name: retinoic acid receptor, gamma
  ENST ID: ENST00000546717
  CDS Start-End: 384-555
ttttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccaggacttttggaggcccagtgggcaggccaggcagggcgggtacggagcctcccaggctggggcagtgggcatgggcaggggctgtggctgaagacctcgcccgcccactgcagaccccaggggactctcacaccgcagctgccatggccaccaataaggagcgactctttgcggctggtgccctggggcctggatctggctacccaggggcaggtttccccttcgccttcccaggggcactcagggggtctccgcctttcgagatgctgagccctagcttccggggcctgggccagcctgacctccccaaggaga

SEQ ID NO: 175425 - DNA, 586 bp, Homo sapiens
  Payload ID: 14453
  Gene Symbol: RARG
  Gene Name: retinoic acid receptor, gamma
  ENST ID: ENST00000551158
  CDS Start-End: 489-586
acagacaactcaactagtccccccaaaaggcagaaaggagaaaagtgccagagagaaaagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagcagctacggcccagttccctcaacctgacccagtatgtagaagccagtctctgcaggcggccagcgggacttttggaggcccagtgggcaggccaggcagggcgggtacggagcctcccaggctggggcagtgggcatgggcaggggctgtggctgaagacctcgcccgcccactgcagaccccaggggactctcacaccgcagctgccatggccaccaataaggagcgactctttgcggctggtgccctggggcctggatctggctacccaggggcaggtttccccttcgccttcccaggggcact

SEQ ID NO: 175426 - DNA, 1846 bp, Homo sapiens
  Payload ID: 14454
  Gene Symbol: RXRA
  Gene Name: retinoid X receptor, alpha
  Uniprot ID: P19793
  ENST ID: ENST00000481739
  CDS Start-End: 53-1441
cgcccgccgcccgctgcctgcgccgccggccgggcatgagttagtcgcagacatggacaccaaacatttcctgccgctcgatttctccacccaggtgaactcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattc

SEQ ID NO: 175427 - DNA, 2908 bp, Homo sapiens
  Payload ID: 14455
  Gene Symbol: RXRB
  Gene Name: retinoid X receptor, beta
  Uniprot ID: P28702
  ENST ID: ENST00000374680
  CDS Start-End: 213-1814
ggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttctcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccctatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 175428 - DNA, 2846 bp, Homo sapiens
  Payload ID: 14455
  Gene Symbol: RXRB
  Gene Name: retinoid X receptor, beta
  Uniprot ID: P28702
  ENST ID: ENST00000374685
  CDS Start-End: 139-1752
gcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttctcacaccgatccattgatgttcgagatggcatcctccttgccacaggtcttcacgtgcaccgcaactcagcccattcagcaggagtaggagccatctttgatcggtccctctccagggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccctatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 175429 - DNA, 2832 bp, Homo sapiens
  Payload ID: 14455
  Gene Symbol: RXRB
  Gene Name: retinoid X receptor, beta
  Uniprot ID: P28702
  ENST ID: ENST00000383216
  CDS Start-End: 139-1752
gcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcggtccctctccagggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgcccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaa

SEQ ID NO: 175430 - DNA, 2909 bp, Homo sapiens
  Payload ID: 14455
  Gene Symbol: RXRB
  Gene Name: retinoid X receptor, beta
  Uniprot ID: P28702
  ENST ID: ENST00000383217
  CDS Start-End: 213-1814
ggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgcccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 175431 - DNA, 287 bp, Homo sapiens
  Payload ID: 14455
  Gene Symbol: RXRB
  Gene Name: retinoid X receptor, beta
  ENST ID: ENST00000437617
  CDS Start-End: 1-287
gcagcccaaatgaccctgtgactaacatctgtcaggcagctgacaaacagctattcacgcttgttgagtgggcgaagaggatcccacacttttcctccttgcctctggatgatcaggtcatattgctgcgggcaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagat

SEQ ID NO: 175432 - DNA, 287 bp, Homo sapiens; identical to SEQ ID NO: 175431
  Payload ID: 14455
  Gene Symbol: RXRB
  Gene Name: retinoid X receptor, beta
  ENST ID: ENST00000441299
  CDS Start-End: 1-287

SEQ ID NO: 175433 - DNA, 2846 bp, Homo sapiens
  Payload ID: 14455
  Gene Symbol: RXRB
  Gene Name: retinoid X receptor, beta
  Uniprot ID: P28702
  ENST ID: ENST00000431161
  CDS Start-End: 139-1752
gcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcggtccctctccagggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 175434 - DNA, 2832 bp, Homo sapiens; identical to SEQ ID NO: 175429
  Payload ID: 14455
  Gene Symbol: RXRB
  Gene Name: retinoid X receptor, beta
  Uniprot ID: P28702
  ENST ID: ENST00000456244
  CDS Start-End: 139-1752

SEQ ID NO: 175435 - DNA, 2846 bp, Homo sapiens; identical to SEQ ID NO: 175428
  Payload ID: 14455
  Gene Symbol: RXRB
  Gene Name: retinoid X receptor, beta
  Uniprot ID: P28702
  ENST ID: ENST00000455462
  CDS Start-End: 139-1752

SEQ ID NO: 175436 - DNA, 2908 bp, Homo sapiens; identical to SEQ ID NO: 175427
  Payload ID: 14455
  Gene Symbol: RXRB
  Gene Name: retinoid X receptor, beta
  Uniprot ID: P28702
  ENST ID: ENST00000415157
  CDS Start-End: 213-1814

SEQ ID NO: 175437 - DNA, 2846 bp, Homo sapiens
  Payload ID: 14455
  Gene Symbol: RXRB
  Gene Name: retinoid X receptor, beta
  Uniprot ID: P28702
  ENST ID: ENST00000443603
  CDS Start-End: 139-1752
gcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcggtccctctccagggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 175438 - DNA, 287 bp, Homo sapiens; identical to SEQ ID NO: 175431
  Payload ID: 14455
  Gene Symbol: RXRB
  Gene Name: retinoid X receptor, beta
  ENST ID: ENST00000415668
  CDS Start-End: 1-287

SEQ ID NO: 175439 - DNA, 287 bp, Homo sapiens; identical to SEQ ID NO: 175431
  Payload ID: 14455
  Gene Symbol: RXRB
  Gene Name: retinoid X receptor, beta
  ENST ID: ENST00000428813
  CDS Start-End: 1-287

SEQ ID NO: 175440 - DNA, 2908 bp, Homo sapiens
  Payload ID: 14455
  Gene Symbol: RXRB
  Gene Name: retinoid X receptor, beta
  Uniprot ID: P28702
  ENST ID: ENST00000415909
  CDS Start-End: 213-1814
ggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 175441 - DNA, 2894 bp, Homo sapiens
  Payload ID: 14455
  Gene Symbol: RXRB
  Gene Name: retinoid X receptor, beta
  Uniprot ID: P28702
  ENST ID: ENST00000431820
  CDS Start-End: 213-1814
ggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgcccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaa

SEQ ID NO: 175442 - DNA, 287 bp, Homo sapiens; identical to SEQ ID NO: 175431
  Payload ID: 14455
  Gene Symbol: RXRB
  Gene Name: retinoid X receptor, beta
  ENST ID: ENST00000451068
  CDS Start-End: 1-287

SEQ ID NO: 175443 - DNA, 2908 bp, Homo sapiens
  Payload ID: 14455
  Gene Symbol: RXRB
  Gene Name: retinoid X receptor, beta
  Uniprot ID: P28702
  ENST ID: ENST00000436753
  CDS Start-End: 213-1814
ggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 175444 - DNA, 1977 bp, Homo sapiens
  Payload ID: 14455
  Gene Symbol: RXRB
  Gene Name: retinoid X receptor, beta
  ENST ID: ENST00000485267
  CDS Start-End: 162-401
tggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaa

SEQ ID NO: 175445 - DNA, 1977 bp, Homo sapiens
  Payload ID: 14455
  Gene Symbol: RXRB
  Gene Name: retinoid X receptor, beta
  ENST ID: ENST00000483281
  CDS Start-End: 162-401
tggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttctcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaa

SEQ ID NO: 175446 - DNA, 1977 bp, Homo sapiens; identical to SEQ ID NO: 175445
  Payload ID: 14455
  Gene Symbol: RXRB
  Gene Name: retinoid X receptor, beta
  ENST ID: ENST00000462174
  CDS Start-End: 162-401

SEQ ID NO: 175447 - DNA, 1977 bp, Homo sapiens; identical to SEQ ID NO: 175444
  Payload ID: 14455
  Gene Symbol: RXRB
  Gene Name: retinoid X receptor, beta
  ENST ID: ENST00000468440
  CDS Start-End: 162-401

SEQ ID NO: 175448 - DNA, 1977 bp, Homo sapiens
  Payload ID: 14455
  Gene Symbol: RXRB
  Gene Name: retinoid X receptor, beta
  ENST ID: ENST00000463338
  CDS Start-End: 162-401
tggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaa

SEQ ID NO: 175449 - DNA, 1227 bp, Homo sapiens
  Payload ID: 14455
  Gene Symbol: RXRB
  Gene Name: retinoid X receptor, beta
  ENST ID: ENST00000531100
  CDS Start-End: 72-1115
accttcgccctaatgcctttaccaatatggcggcactccggtagcgacgaatccatcctgcactgacacgcatgcgcgagtgtggaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcggtccctctccagggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgaga

SEQ ID NO: 175450 - DNA, 1977 bp, Homo sapiens; identical to SEQ ID NO: 175444
  Payload ID: 14455
  Gene Symbol: RXRB
  Gene Name: retinoid X receptor, beta
  ENST ID: ENST00000465169
  CDS Start-End: 162-401

SEQ ID NO: 175451 - DNA, 2041 bp, Homo sapiens
  Payload ID: 14456
  Gene Symbol: RXRG
  Gene Name: retinoid X receptor, gamma
  Uniprot ID: P48443
  ENST ID: ENST00000359842
  CDS Start-End: 304-1695
gcggtggcaagagtagcggtgacggcggcggcggcggcggcggcagcattatgcgtgattactgacaggcaccagctgctgccgccacagccgtctcaaacgcactatgtggactctccgatctagaggcagattcctgactaatcccagagggctggcccagcctgtgctccccgggctgctaggaagcgatgaccactcttgttagcccaagttgaagaaagccgggctgtgcctgggagccgagagaggcggtaatatttagaagctgcacaggagaggaacatgaactgacgagtaaacatgtatggaaattattctcacttcatgaagtttcccgcaggctatggaggctcccctggccacactggctctacatccatgagcccatcagcagccttgtccacagggaagccaatggacagccaccccagctacacagataccccagtgagtgccccacggactctgagtgcagtggggacccccctcaatgccctgggctctccatatcgagtcatcacctctgccatgggcccaccctcaggagcacttgcagcgcctccaggaatcaacttggttgccccacccagctctcagctaaatgtggtcaacagtgtcagcagttcagaggacatcaagcccttaccagggcttcccgggattggaaacatgaactacccatccaccagccccggatctctggttaaacacatctgtgccatctgtggagacagatcctcaggaaagcactacggggtatacagttgtgaaggctgcaaagggttcttcaagaggacgataaggaaggacctcatctacacgtgtcgggataataaagactgcctcattgacaagcgtcagcgcaaccgctgccagtactgtcgctatcagaagtgccttgtcatgggcatgaagagggaagctgtgcaagaagaaagacagaggagccgagagcgagctgagagtgaggcagaatgtgctaccagtggtcatgaagacatgcctgtggagaggattctagaagctgaacttgctgttgaaccaaagacagaatcctatggtgacatgaatatggagaactcgacaaatgaccctgttaccaacatatgtcatgctgctgacaagcagcttttcaccctcgttgaatgggccaagcgtattccccacttctctgacctcaccttggaggaccaggtcattttgcttcgggcagggtggaatgaattgctgattgcctctttctcccaccgctcagtttccgtgcaggatggcatccttctggccacgggtttacatgtccaccggagcagtgcccacagtgctggggtcggctccatctttgacagagtcctaactgagctggtttccaaaatgaaagacatgcagatggacaagtcggaactgggatgcctgcgagccattgtactctttaacccagatgccaagggcctgtccaacccctctgaggtggagactctgcgagagaaggtttatgccacccttgaggcctacaccaagcagaagtatccggaacagccaggcaggtttgccaagctgctgctgcgcctcccagctctgcgttccattggcttgaaatgcctggagcacctcttcttcttcaagctcatcggggacacccccattgacaccttcctcatggagatgttggagaccccgctgcagatcacctgagccccaccagccacagcctccccacccaggatgacccctgggcaggtgtgtgtggacccccaccctgcactttcctccacctcccaccctgacccccttcctgtccccaaaatgtgatgcttataataaagaaaacctttctacacatgagacttttataggtggacttttgtatagatgttaaaggtaatacgctttgctgtctacagggctgggagactttctggaagttcttgggaaaactaatcaagcctctgtacatacaattggtttaaattattttttcacttgccctggaaagcaaacaaatgagtaataaaataatatgtgtgaaattggcactgct

SEQ ID NO: 175452 - DNA, 2252 bp, Homo sapiens
  Payload ID: 14456
  Gene Symbol: RXRG
  Gene Name: retinoid X receptor, gamma
  ENST ID: ENST00000619224
  CDS Start-End: 890-1912
acctacaccgggcggtcatacatcgattggcttcctagataatagatcgtgccacccggtagggacctctggggacgcgccgggagctggaagagtcgcacgcagcagcccaaccctgagttaatcaaactagcaacaggatctcaagcagcagcgacggcggtggcaagagtagcggtgacggcggcggcggcggcggcggcagcattatgcgtgattactgacaggcaccagctgctgccgccacagccgtctcaaacgcactatgtggactctccgatctagaggcagattcctgactaatcccagagggctggcccagcctgtgctccccgggctgctaggaagcgatgaccactcttgttagcccaagttgaagaaagccgggctgtgcctgggagccgagagaggcggtaatatttagaagctgcacaggagaggaacatgaactgacgagtaaacatgtatggaaattattctcacttcatgaagtttcccgcaggctatggaggctcccctggccacactggctctacatccatgagcccatcagcagccttgtccacagggaagccaatggacagccaccccagctacacagataccccagtgagtgccccacggactctgagtgcagtggggacccccctcaatgccctgggctctccatatcgagtcatcacctctgccatgggcccaccctcaggagcacttgcagcgcctccaggaatcaacttggttgccccacccagctctcaggactggtctgagagggattcatgatggaagcatgttcattctgtgacctggttctcgcctaaatgtggtcaacagtgtcagcagttcagaggacatcaagcccttaccagggcttcccgggattggaaacatgaactacccatccaccagccccggatctctggttaaacacatctgtgccatctgtggagacagatcctcaggaaagcactacggggtatacagttgtgaaggctgcaaagggttcttcaagaggacgataaggaaggacctcatctacacgtgtcgggataataaagactgcctcattgacaagcgtcagcgcaaccgctgccagtactgtcgctatcagaagtgccttgtcatgggcatgaagagggaagctgtgcaagaagaaagacagaggagccgagagcgagctgagagtgaggcagaatgtgctaccagtggtcatgaagacatgcctgtggagaggattctagaagctgaacttgctgttgaaccaaagacagaatcctatggtgacatgaatatggagaactcgacaaatgaccctgttaccaacatatgtcatgctgctgacaagcagcttttcaccctcgttgaatgggccaagcgtattccccacttctctgacctcaccttggaggaccaggtcattttgcttcgggcagggtggaatgaattgctgattgcctctttctcccaccgctcagtttccgtgcaggatggcatccttctggccacgggtttacatgtccaccggagcagtgcccacagtgctggggtcggctccatctttgacagagtcctaactgagctggtttccaaaatgaaagacatgcagatggacaagtcggaactgggatgcctgcgagccattgtactctttaacccagatgccaagggcctgtccaacccctctgaggtggagactctgcgagagaaggtttatgccacccttgaggcctacaccaagcagaagtatccggaacagccaggcaggtttgccaagctgctgctgcgcctcccagctctgcgttccattggcttgaaatgcctggagcacctcttcttcttcaagctcatcggggacacccccattgacaccttcctcatggagatgttggagaccccgctgcagatcacctgagccccaccagccacagcctccccacccaggatgacccctgggcaggtgtgtgtggacccccaccctgcactttcctccacctcccaccctgacccccttcctgtccccaaaatgtgatgcttataataaagaaaacctttctacacatgagacttttataggtggacttttgtatagatgttaaaggtaatacgctttgctgtctacagggctgggagactttctggaagttcttgggaaaactaatcaagcctctgtacatacaattggtttaaattattttttcacttgccctggaaagcaaacaaatgagtaataaaataatatgtgtgaaattggc

SEQ ID NO: 175453 - DNA, 898 bp, Homo sapiens
  Payload ID: 14457
  Gene Symbol: RBP1
  Gene Name: retinol binding protein 1, cellular
  ENST ID: ENST00000232219
  CDS Start-End: 112-705
aaacgaactgaacgtctgaaacgaaggtggcgcggcctggacaaacctgacccttcgacatcccccgcccctgcgcccgccctcgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtgaggcccaggcagacaaccttgtcccaaggaatcagcaggatgtgtgggccaggatccccctctttgcacagcatgaggcaaaaatgtccagccacccccaggcatctgttagcagagtctgtctcttggctttgtcacttttccttttcttaaaacaaagccatgccaataaagtgatctgtgttcaaaacgtc

SEQ ID NO: 175454 - DNA, 1935 bp, Homo sapiens
  Payload ID: 14457
  Gene Symbol: RBP1
  Gene Name: retinol binding protein 1, cellular
  ENST ID: ENST00000483943
  CDS Start-End: 188-463
aatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgagtgaaactggcttttcctcttgaatgtgctgacttttgattccagccccccaggaatggatcagagaagaggagccgctacccacccactcatcagcctggcctcaggggcagctcatggactttttagccagagagaaccgggttcaagttatggctcaagccctaaccccttggtgatgggctggttacttatagaagcctaatttttatcagctctaaagcttgaagatttagtgaaacattgtggaaagctcccagcacagtacctggcacctggcaggttctctgtcatctcccctacttttccctcctgatcacttatttaacacaagcaccagatgctgaaaaccctctaattgtcccaggaacacacataccctcaaagggagaagcacactttcaaatcaaactccaggatttgcatcttttagcaatttccattatgcggagaaagtatctactcactgtctggttttgaaattttaccccaaatcgaaagagcatgggttttggtgtcagacctgggtcggtcctggctctggcctttgcaggcagtatcaccacgggcaaggcttcacctctcataacctggctgtggaaccacagaaacaacagaattcagtcccagccctccagaggtggatccgtaaacagagggactactagggctgggtggagggctgtgagtgatccaacatcccctgctcttgagagtggtgttttagcatgggagtgttaatgaatgtcacaagtttcttgataccaaatagagttcctaccatttgcaggtcataccggtcactgccaagagatggcttatttagtgggaattgtctggcactcctagtataagtcacctaagtggggcaagtgggccttgaaacatccctgggagacactcactcaggctgcctgtgggagctgggctttttgtgtcactctcccatgcagcagtgacggctggggtttctaagtggtcagaggagctggaaaatggcttctgaagtaacagtcccttgtcatagtggtacaaagatgtcttcattcatctgttggcacatgtctctgggtaaactgccggcaaggccaaagtgatgggggttattattagtttttaatagaaaagttagactggcttcactttccaaccagcttccctagttccagcccatttgcagacttttgggtggtctgtgggatgaaaatttcttgtgaggaggtgagctgaagatggccatccctcctggttgctcttggattgtctgggcttcatttctaaggcggtcccagagcccatgtgggggttgggggaagcagcattgtctagcccctttggtttgtacccatgttcaccccacccccacagccacctgccttttctgtgggacttgaaaagcatcaggaatatcttcctacctgaaattcttccattagaccctgattaattggattaatctaggaaaccagattaaatgaccatttaacgacccttt

SEQ ID NO: 175455 - DNA, 1072 bp, Homo sapiens
  Payload ID: 14457
  Gene Symbol: RBP1
  Gene Name: retinol binding protein 1, cellular
  ENST ID: ENST00000487424
  CDS Start-End: 157-453
gggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatggtgaggattcgcgtccacctggtgtctcctgcccagggggcctgaccaagggctgggctagttcatccgagagggggcaagggcctgagggactgaaaactcttcccactctcagcccccatggtgggcagcaccaactcatgaagcatcctgctctatctacactggaaggtgatggttatgaaggctgccatgtgctgtgtctccactgcgttcaggcactctgcccggtgctttatgcacatgacttcacctaagcctcacacagcctttgagggagatatgaatatgcccattttacagatgaagaaacagtctcaaagagatgaagtaacatgtccagagtagcacagctagggagggtctggagttcaaagcatgtctgttgatgccgttctctggctgactgggctggtggagggtaaaagaaaagaaaggaggaaagaaaaaagaaacacagagtgaaactggcttttcctcttgaatgtgctgacttttgattccagccccccaggaatggatcagagaagaggagccgctacccacccactcatcagcctggcctcaggggcagctcatggactttttagccagagagaaccgggttcaagttatggctcaagccctaaccccttggtgatgggctggttacttatagaagcct

SEQ ID NO: 175456 - DNA, 1487 bp, Homo sapiens
  Payload ID: 14457
  Gene Symbol: RBP1
  Gene Name: retinol binding protein 1, cellular
  Uniprot ID: P09455
  ENST ID: ENST00000492918
  CDS Start-End: 112-585
aaacgaactgaacgtctgaaacgaaggtggcgcggcctggacaaacctgacccttcgacatcccccgcccctgcgcccgccctcgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatggctggagtgcaatcgcgtgatctcagctcactgtaacctctgcctcccgggttcaagcaattctcctgcctcagcctcccaagtagctgggattacagtcacacgccaccacacctggataattttgtatttttggtagagacagggtttcactatgttggtcaggctggtctcaaactcctgagctcaggtgatccatctgcctcagcctcccaaaatgctgggattacaagtgtgagccactacacctggttcttctttccactgtttgctaactcccatggtgttttctggcatcacttccagcattatttctagccttacctcttccaggaagccttccctgatgggcctctgtctctaccttaaaggctgtcgaggtgccttctgacttccataacctccagcatttgtctaccagtacttaccattctgctggaattctctgtcttcttaccttcttctcagataatctgtgagccctcaagagcaggccactgaccttacttccctctctccagcacctacagctggtgcataggaggtgtgaaacccatgattgctgaatgccgttcccttgcacagaaccacgtggtgaattcctattgctcagtcaagggtcagtttaaagcagggaactgcagagcacagtcatcaagagcatgagctctagagccaaatctcatctccccacttcacggctgggtgaacttcaggcctcagtctccacatttgtaaaatgatgagaagcatacctgctctaggaggttgtcaggagtcaactggtatgacatatactttgcctagtaccctgcccagcacataatgttgggcattatcattatcataacaacacatgttgttatgatattgattatggtgactgataatgacagcaatgctatcactcccaccagggagccttccctgacccccca

SEQ ID NO: 175457 - DNA, 667 bp, Homo sapiens
  Payload ID: 14457
  Gene Symbol: RBP1
  Gene Name: retinol binding protein 1, cellular
  Uniprot ID: P09455
  ENST ID: ENST00000617459
  CDS Start-End: 112-573
aaacgaactgaacgtctgaaacgaaggtggcgcggcctggacaaacctgacccttcgacatcccccgcccctgcgcccgccctcgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgagtgaaactggcttttcctcttgaatgtgctgacttttgattccagccccccaggaatggatcagagaagaggagccgctacccacccactcatcagcctggcctcaggggcagctca

SEQ ID NO: 175458 - DNA, 516 bp, Homo sapiens
  Payload ID: 14457
  Gene Symbol: RBP1
  Gene Name: retinol binding protein 1, cellular
  Uniprot ID: P09455
  ENST ID: ENST00000619087
  CDS Start-End: 56-463
cagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtgaggcccaggcagacaaccttgtcccaaggaatcagcaggatgtgtgggccagga

SEQ ID NO: 175459 - DNA, 694 bp, Homo sapiens
  Payload ID: 14458
  Gene Symbol: RBP2
  Gene Name: retinol binding protein 2, cellular
  Uniprot ID: P50120
  ENST ID: ENST00000232217
  CDS Start-End: 58-462
ctgcagcctgctccttgccatccaccacaaaccctcaccgaaccagtggccaccaccatgacaagggaccagaatggaacctgggagatggagagtaatgaaaactttgagggctacatgaaggccctggatattgattttgccacccgcaagattgcagtacgtctcactcagacgaaggttattgatcaagatggtgataacttcaagacaaaaaccactagcacattccgcaactatgatgtggatttcactgttggagtagagtttgacgagtacacaaagagcctggataaccggcatgttaaggcactggtcacctgggaaggtgatgtccttgtgtgtgtgcaaaagggggagaaggagaaccgcggctggaagcagtggattgagggggacaagctgtacctggagctgacctgtggtgaccaggtgtgccgtcaagtgttcaaaaagaaatgatggcgacgtgggaggcctgccaagcacaagctccccactgcccacactgagtggtctactggctttgagaaacagctgtggggaccttcccactcttgacagagccccattaaggcatctgggtgggttttaaacagaatgcctatgtagcagtgatagacatattcccctcctttgaaacctagcattaaatggaaaaacaaaaattactcccatattttgaaacccttta

SEQ ID NO: 175460 - DNA, 180 bp, Homo sapiens
  Payload ID: 14458
  Gene Symbol: RBP2
  Gene Name: retinol binding protein 2, cellular
  ENST ID: ENST00000506825
  CDS Start-End: 108-180
tagggagccagcccaggagcccagctgctgcagtcagatgctcccaaggacagcagcctgctccttgccatccaccacaaaccctcaccgaaccagtggccaccaccatgacaagggaccagaatggaacctgggagatggagagtaatgaaaactttgagggctacatgaaggccctgg

SEQ ID NO: 175461 - DNA, 489 bp, Homo sapiens
  Payload ID: 14458
  Gene Symbol: RBP2
  Gene Name: retinol binding protein 2, cellular
  ENST ID: ENST00000511956
  CDS Start-End: 179-489
ctgctgcagtcagatgctcccaaggacagcagtctccagaaagcttcttgtaacctggaaagattggttatagttgatcattttcctccatcttaaaagtcacctgaagaattccacaaggacttagcctgctccttgccatccaccacaaaccctcaccgaaccagtggccaccaccatgacaagggaccagaatggaacctgggagatggagagtaatgaaaactttgagggctacatgaaggccctggatattgattttgccacccgcaagattgcagtacgtctcactcagacgaaggttattgatcaagatggtgataacttcaagacaaaaaccactagcacattccgcaactatgatgtggatttcactgttggagtagagtttgacgagtacacaaagagcctggataaccggcatgttaaggcactggtcacctgggaaggtgatgtccttgtgtgtgtgcaaaagggggagaaggagaa

SEQ ID NO: 175462 - DNA, 4276 bp, Homo sapiens
  Payload ID: 14459
  Gene Symbol: RBP3
  Gene Name: retinol binding protein 3, interstitial
  Uniprot ID: P10745
  ENST ID: ENST00000584701
  CDS Start-End: 115-3858
tgtccaccagctgagaaggacaagggcggaaggcagctgcacagagcagggccacggccttgcacacagtccagggagcttttgtgcaggagccaggcctccccctgggtccccatgatgagagaatgggttctgctcatgtccgtgctgctctgtggcctggctggccccacacacctgttccagccaagcctggtgctggacatggccaaggtcctcttggataactactgcttcccggagaacctgctgggcatgcaggaagccatccagcaggccatcaagagccatgagattctgagcatctcagacccgcagacgctggccagtgtgctgacagccggggtgcagagctccctgaacgatcctcgcctggtcatctcctatgagcccagcacccccgagcctcccccacaagtcccagcactcaccagcctctcagaagaggaactgcttgcctggctgcaaaggggcctccgccatgaggttctggagggtaatgtgggctacctgcgggtggacagcgtcccgggccaggaggtgctgagcatgatgggggagttcctggtggcccacgtgtgggggaatctcatgggcacctccgccttagtgctggatctccggcactgcacaggaggccaggtctctggcattccctacatcatctcctacctgcacccagggaacaccatcctgcacgtggacactatctacaaccgcccctccaacaccaccacggagatctggaccttgccccaggtcctgggagaaaggtacggtgccgacaaggatgtggtggtcctcaccagcagccagaccaggggcgtggccgaggacatcgcgcacatccttaagcagatgcgcagggccatcgtggtgggcgagcggactgggggaggggccctggacctccggaagctgaggataggcgagtctgacttcttcttcacggtgcccgtgtccaggtccctggggccccttggtggaggcagccagacgtgggagggcagcggggtgctgccctgtgtggggactccggccgagcaggccctggagaaagccctggccatcctcactctgcgcagcgcccttccaggggtagtccactgcctccaggaggtcctgaaggactactacacgctggtggaccgtgtgcccaccctgctgcagcacttggccagcatggacttctccacggtggtctccgaggaagatctggtcaccaagctcaatgccggcctgcaggctgcgtctgaggatcccaggctcctggtgcgagccatcgggcccacagaaactccttcttggcccgcgcccgacgctgcagccgaagactcaccaggggtggccccagagttgcctgaggacgaggctatccggcaagcactggtggactctgtgttccaggtgtcggtgctgccaggcaatgtgggctacctgcgcttcgatagttttgctgacgcctccgtcctgggtgtgttggccccatatgtcctgcgccaggtgtgggagccgctacaggacacggagcacctcatcatggacctgcgccacaaccctggagggccatcctctgctgtgcccctgctcctgtcctacttccagggccctgaggccggccccgtgcacctcttcaccacctatgatcgccgcaccaacatcacgcaggagcacttcagccacatggagctcccgggcccacgctacagcacccaacgtggggtgtatctgctcaccagccaccgcaccgccacggccgcggaggagttcgccttccttatgcagtcgctgggctgggccacactggtaggtgagatcaccgcgggcaacctgctgcacacccgcacggtgccgctgctggacacacccgaaggcagcctcgcgctcaccgtgccggtcctcaccttcatcgacaatcacggcgaggcctggctgggtggtggagtggtgcccgatgccatcgtgctggccgaggaggccctggacaaagcccaggaagtgctggagttccaccaaagcctgggggccttggtggagggcacagggcacctgctggaggcccactatgctcggccagaggtcgtggggcagaccagtgccctcctgcgggccaagctggcccagggcgcctaccgcacagctgtggacttggagtctctggcctctcagctcacagcagacctccaggaggtgtctggggaccaccgcttgctagtgttccacagccctggcgagctggtggtagaggaagcacccccaccaccccctgctgtcccctctccagaggagctcacctaccttattgaggccctgttcaagacagaggtgctgcccggccagctgggctacctgcgttttgacgccatggctgaactggagacagtgaaggccgtggggccacagctggtgcggctggtatggcaacagctggtggacacggctgcgctggtgatcgacctgcgctacaaccctggcagctactccacggccatcccgctgctctgctcctacttctttgaggcagagccccgccagcacctgtattctgtctttgacagggccacctcaaaagtcacggaggtgtggaccttgccccaggtcgccggccagcgctacggctcacacaaggacctctacatcctgatgagccacaccagtggctctgcggccgaggcctttgcacacaccatgcaggacctgcagcgggccacggtcattggggagcccacggccggaggcgcactctctgtgggcatctaccaggtgggcagcagccccttatatgcatccatgcccacccagatggccatgagtgccaccacaggcaaggcctgggacctggctggtgtggagcccgacatcactgtgcccatgagcgaagccctttccatagcccaggacatagtggctctgcgtgccaaggtgcccacggtgctgcagacggccgggaagctggtggctgataactatgcctctgccgagctgggggccaagatggccaccaaactgagcggtctgcagagccgctactccagggtgacctcagaagtggccctagccgagatcctgggggctgacctgcagatgctctccggagacccacacctgaaggcagcccatatccctgagaatgccaaggaccgcattcctggaattgtgcccatgcagatcccttcccctgaagtatttgaagagctgatcaagttttccttccacactaacgtgcttgaggacaacattggctacttgaggtttgacatgtttggggacggtgagctgctcacccaggtctccaggctgctggtggagcacatctggaagaagatcatgcacacggatgccatgatcatcgacatgaggttcaacatcggtggccccacatcctccattcccatcttgtgctcctacttctttgatgaaggccctccagttctgctggacaagatctacagccggcctgatgactctgtcagtgaactctggacacacgcccaggttgtaggtgaacgctatggctccaagaagagcatggtcattctgaccagcagtgtgacggccggcaccgcggaggagttcacctatatcatgaagaggctgggccgggccctggtcattggggaggtgaccagtgggggctgccagccaccacagacctaccacgtggatgacaccaacctctacctcactatccccacggcccgttctgtgggggcctcggatggcagctcctgggaaggggtgggggtgacaccccatgtggttgtccctgcagaagaggctctcgccagggccaaggagatgctccagcacaaccagctgagggtgaagcggagcccaggcctgcaggaccacctgtagggaagggccccataggcagagccccagggcagacagaacctctgggacacacaccaagggcactcctgcaggtggcccggcctgaggttcccaggagcagcaaaggggcctgctgagctctggttaggttacagctggaggtgtgtatatatacacacacacacatgtatatacacatatatatgtgtatgtatatatatgtatatatatatggctttccaataaccacctaaattttaacaaaggttccttctaagtggtagaacttggggtggtatttttaccttccttcttcatactttgctctttttcttaaatactcattaatgtgcatatatcattattttcagatgcagctatcattattccaaaatacaaaataaagaagataaaataaattatatacccgagccattaa

SEQ ID NO: 175463 - DNA, 1068 bp, Homo sapiens
  Payload ID: 14460
  Gene Symbol: RBP4
  Gene Name: retinol binding protein 4, plasma
  Uniprot ID: P02753
  ENST ID: ENST00000371464
  CDS Start-End: 75-680
gctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgattttagttttcatttgtgtttatgtctgtgctgcagacggatgggtggggtgcgcttctttataccaggagcacgtggctctttctgacctttggcctgttctagtgcctaatctccattattaaatactggcttctcccaacttcctg

SEQ ID NO: 175464 - DNA, 1314 bp, Homo sapiens
  Payload ID: 14460
  Gene Symbol: RBP4
  Gene Name: retinol binding protein 4, plasma
  Uniprot ID: P02753
  ENST ID: ENST00000371467
  CDS Start-End: 321-926
gccaatttggcatggccagggcctgggcactcacgcaccagggagcctcgcgggtccgctctcgctctgtgaggccacggtcttcccgccaggttgactcgagcctcctgccagagccactggccccggaggccaccctagaccgcagctggcggccgctggcacgagtgcagggtaactgagccagggccgctggcgcatttggcctggccgaggccaccccgcgcggccgctccactgtgcccgaggctgtcctggaggtgaggccggcccacagggaccctgcccgtgcccgggctccgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgattttagttttcatttgtgtttatgtctgtgctgcagacggatgggtggggtgcgcttctttataccaggagcacgtggctctttctgacctttggcctgttctagtgcctaatctccattattaaatactggcttctcccaacttcctg

SEQ ID NO: 175465 - DNA, 814 bp, Homo sapiens
  Payload ID: 14460
  Gene Symbol: RBP4
  Gene Name: retinol binding protein 4, plasma
  ENST ID: ENST00000371469
  CDS Start-End: 29-628
atcctttataaaatgaaaaactacttggatgaattattccaaaattcctgcacaagtggacctcagaaggcagacggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggg

SEQ ID NO: 175466 - DNA, 882 bp, Homo sapiens
  Payload ID: 14460
  Gene Symbol: RBP4
  Gene Name: retinol binding protein 4, plasma
  ENST ID: ENST00000615669
  CDS Start-End: 52-651
cggccaggcttgcgcgcggttcccctcccggtgggcggattcctgggcaagatgaagtgggtgtgggcgctcttgctgttggcggcgtgggcagcggccgagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtg

SEQ ID NO: 175467 - DNA, 838 bp, Homo sapiens
  Payload ID: 14460
  Gene Symbol: RBP4
  Gene Name: retinol binding protein 4, plasma
  ENST ID: ENST00000629763
  CDS Start-End: 1-600
atgaattattccaaaattcctgcacaagtggacctcagaaggcagacggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtg

SEQ ID NO: 175468 - DNA, 1012 bp, Homo sapiens
  Payload ID: 14461
  Gene Symbol: RBP5
  Gene Name: retinol binding protein 5, cellular
  Uniprot ID: P82980
  ENST ID: ENST00000266560
  CDS Start-End: 168-575
ttattgcaacagggccccagccttataaaaagccctggtaacccggccattacacatcctgtctctgtgtgtggagctggctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccagaccatagtaacctgggaggaggagcacctggtgtgtgtgcagaaaggggaggtccccaaccggggctggagacactggctggagggagagatgctgtatctggaactgactgcaagggatgcagtgtgcgagcaggtcttcaggaaggtcagatagccggagaggagccaagatccctccagacagcaccagctcacagacgctcttgttgtgcccccttcaagcccagattgtgccaggtcagctgtcccttcctctggccacctttcctccctctgggtccctcctcacccctccccgtgttaatctgtaacttgcagcccccaggccaaagtcctttctcacactccactgcccaatagtgacctcacttccaggtcaaggtctggcgtcccaaatgaaagaagcaggcaaagggaaggagcccctgagaacaaccaatctccgctctctcctgtccatttgacctcttcttttccttctaagaaagaactaagctttgggcatttggcgattagtgaaaattctatcctgatggacttctggaaaactgtgactggggttcaagagtttaaacaggggctactggcaga

SEQ ID NO: 175469 - DNA, 564 bp, Homo sapiens
  Payload ID: 14461
  Gene Symbol: RBP5
  Gene Name: retinol binding protein 5, cellular
  ENST ID: ENST00000542370
  CDS Start-End: 99-392
tgtggagctggctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccaggctgcccttggcatgaattctccagccagagccatctcctgagctccagggcaatgttttcaactgcctacaaaatacagttggccctccatattcatgggttctgcatccacagcttcagcaaactgcaaatggaaaaatatttgggaaaaataaaaataaaaaataacaatacaaaatgatacaaataaaaaacaatacagtatagcaacta

SEQ ID NO: 175470 - DNA, 515 bp, Homo sapiens
  Payload ID: 14461
  Gene Symbol: RBP5
  Gene Name: retinol binding protein 5, cellular
  ENST ID: ENST00000543045
  CDS Start-End: 88-297
ctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaagcagcccccacagacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccaggctgcccttggcatgaattctccagccagagccatctcctgagctccagggcaatgttttcaactgcctacaaaatacagttggccctccatattcatgggttctgcatccacagcttcagcaaactgcaaatggaaaaatatttgggaaaaataaaaataaa

SEQ ID NO: 175471 - DNA, 636 bp, Homo sapiens
  Payload ID: 14462
  Gene Symbol: RBP7
  Gene Name: retinol binding protein 7, cellular
  Uniprot ID: Q96R05
  ENST ID: ENST00000294435
  CDS Start-End: 44-448
gagcctccggccgcccgccgggtttgtcccgcgatccccgaccatgcccgccgacctcagcggtacttggaccctgctcagcagcgacaacttcgagggctacatgctggccctaggtattgactttgccactcgtaaaatagccaagttgctgaagccacagaaagtgattgagcagaatggggattcttttaccatccacacgaacagcagcctaaggaactactttgtgaaatttaaagttggagaagaatttgatgaagataacagaggcctggacaacagaaaatgcaagagtttggttatctgggacaatgacaggctcacctgtatccagaagggagaaaagaagaacagaggctggacccattggatcgaaggagacaaactccacctggaaatgttctgtgaaggtcaagtgtgcaaacagacattccagagagcctgatccacatccagcagcagagcccacttgtggctgcagctttatgccaaattatattgcagactgaacagacgtttatctatcccatttggcgacgaggactcgtggctggagagagccacacagcgtgtaacctgaagtcatctagattatggggaaactgctcagcttcaataaacctgtccaaatga

SEQ ID NO: 175472 - DNA, 861 bp, Homo sapiens
  Payload ID: 14462
  Gene Symbol: RBP7
  Gene Name: retinol binding protein 7, cellular
  ENST ID: ENST00000315901
  CDS Start-End: 54-233
gtcccggcccgagcctccggccgcccgccgggtttgtcccgcgatccccgaccatgcccgccgacctcagcggtacttggaccctgctcagcagcgacaacttcgagggctacatgctggccctagatggagttttgctcttgttgcccaggctggagtgcaatggcgggatctcggctcaccgcaacttccgtctccccggttcaaacaattctcctgcttcagcctcctgagtagctgggattgcaggcatgccccaccacgcccagctaattttgtatttttagtagagacggggtttctccatattggtcaggctggtctccaactcccgacctcaggtattgactttgccactcgtaaaatagccaagttgctgaagccacagaaagtgattgagcagaatggggattcttttaccatccacacgaacagcagcctaaggaactactttgtgaaatttaaagttggagaagaatttgatgaagataacagaggcctggacaacagaaaatgcaagagtttggttatctgggacaatgacaggctcacctgtatccagaagggagaaaagaagaacagaggctggacccattggatcgaaggagacaaactccacctggaaatgttctgtgaaggtcaagtgtgcaaacagacattccagagagcctgatccacatccagcagcagagcccacttgtggctgcagctttatgccaaattatattgcagactgaacagacgtttatctatcccatttggcgacgaggactcgtggctggagagagccacacagcgtgtaacctgaagtcatctagattatggggaaactgctcagcttcaataaacctgtccaaatga

SEQ ID NO: 175473 - DNA, 3949 bp, Homo sapiens
  Payload ID: 14463
  Gene Symbol: RDH10
  Gene Name: retinol dehydrogenase 10 (all-trans)
  Uniprot ID: Q8IZV5
  ENST ID: ENST00000240285
  CDS Start-End: 679-1704
cggagcgctctgacttgcaagcgggctgcgctgcggagcccagtgcccgagtgacacccgcggagagtgcagggccggggaacgcgagccctcgggggcagctgcaaggcgttgggcagcgcttgcctgcgccgagcgagtctccccttcccggcgctccgccgccccgcaccccactctcccaccctctcgcaacttgggtcgagttgacaactcccgcggcagcccgctggcccgtgccgcctccgctgcgcacccctcccccggggtgagagggagccggcgcgccggttccggggacgctcgggcggcagcagcttggccatgagggcagttcgagtagtctaactcgcggctgtcaccgccactgcagcggagccggccggccgggcgctgcgggacgggcgggcggctgccggcaggaggcgccgagccgggtgactgccgcggcgggcacagtccggggccacagcgccgagcccgggcgggagtggccccgcgcaggcagggagcggcgccgcgcactccaacccggcgggcacctcgggggcgggcgcggggcgcagccttctcgtcccggcctctgtgacaagcgccccggagccgggagcccgattgccgggctcggggtgggcgcggacgcaggcactgggctcgtgcggggccccgggcgtcgcgatgaacatcgtggtggagttcttcgtggtcactttcaaagtgctctgggcgttcgtgctggccgcggcgcgctggctggtgcggcccaaggagaagagcgtggcgggccaggtgtgcctcatcaccggcgccggcagcggcctgggccgcctcttcgcgctggagttcgcccggcgtcgggcgctgctggtgctgtgggacatcaacacgcaaagcaacgaggagacggctggcatggtgcgccacatctaccgcgacctggaggcggccgacgccgctgcgctgcaagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaaaggctgctgaaaaggatggaattaaaacaaccttggtttgcccttatcttgtagacactggcatgttcagaggctgccgaatcaggaaagaaattgagccttttctgccacctctgaagcctgattactgtgtgaagcaggccatgaaggccatcctcactgaccagcccatgatctgcactccccgcctcatgtacatcgtgaccttcatgaagagcatcctaccatttgaagcagttgtgtgcatgtatcggttcctaggagcggacaagtgtatgtacccctttattgctcaaagaaagcaagccacaaacaataatgaagcaaaaaatggaatctaagaatctttttgtatggaatattacttctatcagaagatgatcaagatgtttcagtccagtgcacatcagcattgctgacattttatggattctaaacttgtgttgtttcttttttaaatcaactttttaaaaaaataaagtgtaaattaaccgactagagtacttggaaaatgtgatcagtacaagtgaacttaggttgttgccaacagggtccttttaggcagaacccagaaaccagtcaaatctgtagagaagcagtgtgacatcttcaggttaccattattttttaatgagcaggaagtctagaaatgataactagactgtatgtttcatgtgtgtgatttttcagaattcccagagtttactcattcttgttattaaactctagccagttgacatcttcgcaatttcaaggactgatagtgctgtattttctcacgttttctaagtttccgttttgcaaggcctaggtgactttttcatggtgtttgtatgtttagctcttttgaaaaggaattttgaaatctccatcaactgaagtaaatgatgtctgagtgttacagtaaaggtgaccaagtctctttcttaaagtcacaatgactaaagtattagttgaatttttttttttttttttttgatggagtctcgctctgtcaccaggctggagtgcagtagcacaatcacggctcactgcaatctctgcctcccagtttcaagtgattctgctgtctcagcctcccaagtagctgggactacaggcatgcgccaccacgcccagctaatttttgtatttttagtagagacggggtttcaccatgttggtcaggatggtctccatctcttgacattgtgatccacctgcctcggcctcccaaagtgctgggattacaggcatgagccactgcacccagccttgaatttttaattttatctctgatatacttcattaagtgtctggagacctaattatcctaaaagatcatacattttctacctatgaattttgctgcatacagaaagtgccctttcctcaggaagttgctgtgtttcatttctttggatggactcttatctagaatacatagcagctctgcaaaggaacagtttttaaaaatgggaacttctacattgaaaagtccccatttttgtgccaactatgattagtgagaggaagaaatcttattctatggcatatgtatggaagggtgtaaagattcttttgaaaggtttattcacattgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcttttttttttagaatgtcttgtttaaatagtggccaatgtttaaggctgttaaaataagccaacttttactaattggggagttttataaatgactgattaaatttaaagaattaacttacatgcaattgtgtgattattagttatcagcagtgttgtaaggaaaattattgtgtttttttttatgatcattatcccactttaggtaaagaaaaatattggaatggaatagtgttgggaaacagacattaacaacctagggtgcctgcactcaaatagccgatgttactgtccctagattagagacttgattaagggcttgtttgtaccaaaagtggggaaacaatgccatgacctgtgttttagtttggctgcaccacagatcaaatctgcactgtgtctacatataggaaaggtcctggtgtgtgctaatgttcccaatgcaggacttgaggaagagctctgttatatgtttccatttctctttatcaaagataaccaaaccttatggcccttataacaatggaggcactggctgcctcttaattttcaatcatggacctaaagaagtactctgaagggtctcaacaatgccaggtggggacagatatactcagagattatccaggtctgcctcccagcgagcctggagtacaccagaccctcctagagaaatctgttataatttaacaacccacttatccaccttaaaactgaggaaagtcgtctttacatctaattttattcttgtgtgttataacttaaacctatttctatttttgtttgttattgcccttataagggtgtccatctccaagttcaataaactaattcatttaa

SEQ ID NO: 175474 - DNA, 978 bp, Homo sapiens
  Payload ID: 14463
  Gene Symbol: RDH10
  Gene Name: retinol dehydrogenase 10 (all-trans)
  ENST ID: ENST00000519380
  CDS Start-End: 385-915
tgggaggaaggcagctgtaaagctcagtcgttggcaagccttgcagcgttagaaatttgaagctcactgtagtatttttgttttgtgtgatctttgtcctactgatcgccatgtgactcactttctgcacttccttctcttttgcatgttttctcctcatctggacttctgaggacagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaaaggctgctgaaaaggatggaattaaaacaaccttggtttgcccttatcttgtagacactggcatgttcagaggctgccgaatcaggaaagaaattgagccttttctgccacctctgaagcctgattactgtgtgaagcaggccatgaaggccatcctcactgaccagcccatgatctgcactccccgcctcatgtacatcgtgaccttcatgaagagcatcctaccatttgaagcagttgtgtgcatgtatcggttcctaggagcggacaagtgtatgtacccctttattgctcaaagaaagcaagccacaaacaataatgaagcaaaaaatggaatctaagaatctttttgtatggaatattacttctatcagaagatgatcaagatgtttcagtccagtgca

SEQ ID NO: 175475 - DNA, 436 bp, Homo sapiens
  Payload ID: 14463
  Gene Symbol: RDH10
  Gene Name: retinol dehydrogenase 10 (all-trans)
  ENST ID: ENST00000521928
  CDS Start-End: 251-436
aagccctccggggtagggaaggcggagggaacttgttaccacagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaa

SEQ ID NO: 175476 - DNA, 2588 bp, Homo sapiens
  Payload ID: 14464
  Gene Symbol: RDH11
  Gene Name: retinol dehydrogenase 11 (all-trans/9-cis/11-cis)
  Uniprot ID: Q8TC12
  ENST ID: ENST00000381346
  CDS Start-End: 112-1068
gtctgctccccgggctgtcgcaatttgaattggggcgtgtctagaaagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgattattttttgttttcatttaccagaataaaaactaagaattaaaagtttgattacagtcaaa

SEQ ID NO: 175477 - DNA, 1064 bp, Homo sapiens
  Payload ID: 14464
  Gene Symbol: RDH11
  Gene Name: retinol dehydrogenase 11 (all-trans/9-cis/11-cis)
  Uniprot ID: Q8TC12
  ENST ID: ENST00000428130
  CDS Start-End: 31-777
cccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaag

SEQ ID NO: 175478 - DNA, 621 bp, Homo sapiens
  Payload ID: 14464
  Gene Symbol: RDH11
  Gene Name: retinol dehydrogenase 11 (all-trans/9-cis/11-cis)
  ENST ID: ENST00000557726
  CDS Start-End: 62-621
aagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagagaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaact

SEQ ID NO: 175479 - DNA, 562 bp, Homo sapiens
  Payload ID: 14464
  Gene Symbol: RDH11
  Gene Name: retinol dehydrogenase 11 (all-trans/9-cis/11-cis)
  ENST ID: ENST00000557273
  CDS Start-End: 28-562
gctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccaga

SEQ ID NO: 175480 - DNA, 849 bp, Homo sapiens
  Payload ID: 14464
  Gene Symbol: RDH11
  Gene Name: retinol dehydrogenase 11 (all-trans/9-cis/11-cis)
  ENST ID: ENST00000554035
  CDS Start-End: 1-615
tctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcata

SEQ ID NO: 175481 - DNA, 888 bp, Homo sapiens
  Payload ID: 14464
  Gene Symbol: RDH11
  Gene Name: retinol dehydrogenase 11 (all-trans/9-cis/11-cis)
  ENST ID: ENST00000554731
  CDS Start-End: 64-249
agaagccatagtcggcgagcaacgctggagcatcccgctctggtgccgctgcagccggcagagatggttgagctcatgttcccgctgttgctcctccttctgcccttccttctgtatatggctgcgccccaaatcaggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaaga

SEQ ID NO: 175482 - DNA, 1926 bp, Homo sapiens
  Payload ID: 14464
  Gene Symbol: RDH11
  Gene Name: retinol dehydrogenase 11 (all-trans/9-cis/11-cis)
  Uniprot ID: Q8TC12
  ENST ID: ENST00000553384
  CDS Start-End: 52-969
cggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaa

SEQ ID NO: 175483 - DNA, 553 bp, Homo sapiens
  Payload ID: 14464
  Gene Symbol: RDH11
  Gene Name: retinol dehydrogenase 11 (all-trans/9-cis/11-cis)
  ENST ID: ENST00000557331
  CDS Start-End: 72-260
ctagaaagagaagccatagtcggcgagcaacgctggagcatcccgctctggtgccgctgcagccggcagagatggttgagctcatgttcccgctgttgctcctccttctgcccttccttctgtatatggctgcgccccaaatcaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctgg

SEQ ID NO: 175484 - DNA, 1833 bp, Homo sapiens
  Payload ID: 14465
  Gene Symbol: RDH12
  Gene Name: retinol dehydrogenase 12 (all-trans/9-cis/11-cis)
  Uniprot ID: Q96NR8
  ENST ID: ENST00000267502
  CDS Start-End: 281-1231
ctccagaggactgtatgctgttcttaaggactctctgcttcctggacaagctcaagctaaggactacatctcccagcaggctgtgctctgacagctcttggatttaaataggattctgggctctgctcagagtcaggctgctgctcagcacccaggacggagaggagcagagaagcagcagaagcagccaagagctggagccagaccaggaacctgagccagagctggggttgaagctggagcagcagcaaaagcaacagcagctacagaagttggaacgatgctggtcaccttgggactgctcacctccttcttctcgttcctgtatatggtagctccatccatcaggaagttctttgctggtggagtgtgtagaacaaatgtgcagcttcctggcaaggtagtggtgatcactggcgccaacacgggcattggcaaggagacggccagagagctcgctagccgaggagcccgagtctatattgcctgcagagatgtactgaagggggagtctgctgccagtgaaatccgagtggatacaaagaactcccaggtgctggtgcggaaattggacctatccgacaccaaatctatccgagcctttgctgagggctttctggcagaggaaaagcagctccatattctgatcaacaatgcgggagtaatgatgtgtccatattccaagacagctgatggctttgaaacccacctgggagtcaaccacctgggccacttcctcctcacctacctgctcctggagcggctaaaggtgtctgcccctgcacgggtggttaatgtgtcctcggtggctcaccacattggcaagattcccttccacgacctccagagcgagaagcgctacagcaggggttttgcctattgccacagcaagctggccaatgtgctttttactcgtgagctggccaagaggctccaaggcaccggggtcaccacctacgcagtgcacccaggcgtcgtccgctctgagctggtccggcactcctccctgctctgcctgctctggcggctcttctccccctttgtcaagacggcacgggagggggcgcagaccagcctgcactgcgccctggctgagggcctggagcccctgagtggcaagtacttcagtgactgcaagaggacctgggtgtctccaagggcccgaaataacaaaacagctgagcgcctatggaatgtcagctgtgagcttctaggaatccggtgggagtagctggtggaagagctgcagctttatcaggcccaatccatgccataatgaacagggaccaaggagaaggccaaccctaaaggattgtcctcttggccagctggtgctgcgaatcctgcctgctctgatcctcttgacccttctgggaatgtttgcacacctgacactcttgtgagactggcttatggcatgagttgtggacacctatagagtgttcttctctaagacctggaaagtcagcaaccctctgggggcagcaggactgggcagatcccaggctgggcatgggggtggcagaagagcccgagaaattgggtcagttccctcatcagcaccagaggctcagctgaggcaagaagagcaccatcactgcctatttctaggggctatacactccaactcttggttgatctctttctttttaaaaatatttgccaccaccctggagtctagaccaacacacaaagatcctggctaaccctggcctatttagattccttcctctcacctggaccttcccatttcaatcatgcagatggtttctttttgtaaagagttccgtttgcctttcaatttttagagaaaataaagactgcattcatctc

SEQ ID NO: 175485 - DNA, 1879 bp, Homo sapiens
  Payload ID: 14465
  Gene Symbol: RDH12
  Gene Name: retinol dehydrogenase 12 (all-trans/9-cis/11-cis)
  Uniprot ID: Q96NR8
  ENST ID: ENST00000551171
  CDS Start-End: 325-1275
gggcacaagcaatcctcccttctcagcttcctgagtggccaggactacagaggactgtatgctgttcttaaggactctctgcttcctggacaagctcaagctaaggactacatctcccagcaggctgtgctctgacagctcttggatttaaataggattctgggctctgctcagagtcaggctgctgctcagcacccaggacggagaggagcagagaagcagcagaagcagccaagagctggagccagaccaggaacctgagccagagctggggttgaagctggagcagcagcaaaagcaacagcagctacagaagttggaacgatgctggtcaccttgggactgctcacctccttcttctcgttcctgtatatggtagctccatccatcaggaagttctttgctggtggagtgtgtagaacaaatgtgcagcttcctggcaaggtagtggtgatcactggcgccaacacgggcattggcaaggagacggccagagagctcgctagccgaggagcccgagtctatattgcctgcagagatgtactgaagggggagtctgctgccagtgaaatccgagtggatacaaagaactcccaggtgctggtgcggaaattggacctatccgacaccaaatctatccgagcctttgctgagggctttctggcagaggaaaagcagctccatattctgatcaacaatgcgggagtaatgatgtgtccatattccaagacagctgatggctttgaaacccacctgggagtcaaccacctgggccacttcctcctcacctacctgctcctggagcggctaaaggtgtctgcccctgcacgggtggttaatgtgtcctcggtggctcaccacattggcaagattcccttccacgacctccagagcgagaagcgctacagcaggggttttgcctattgccacagcaagctggccaatgtgctttttactcgtgagctggccaagaggctccaaggcaccggggtcaccacctacgcagtgcacccaggcgtcgtccgctctgagctggtccggcactcctccctgctctgcctgctctggcggctcttctccccctttgtcaagacggcacgggagggggcgcagaccagcctgcactgcgccctggctgagggcctggagcccctgagtggcaagtacttcagtgactgcaagaggacctgggtgtctccaagggcccgaaataacaaaacagctgagcgcctatggaatgtcagctgtgagcttctaggaatccggtgggagtagctggtggaagagctgcagctttatcaggcccaatccatgccataatgaacagggaccaaggagaaggccaaccctaaaggattgtcctcttggccagctggtgctgcgaatcctgcctgctctgatcctcttgacccttctgggaatgtttgcacacctgacactcttgtgagactggcttatggcatgagttgtggacacctatagagtgttcttctctaagacctggaaagtcagcaaccctctgggggcagcaggactgggcagatcccaggctgggcatgggggtggcagaagagcccgagaaattgggtcagttccctcatcagcaccagaggctcagctgaggcaagaagagcaccatcactgcctatttctaggggctatacactccaactcttggttgatctctttctttttaaaaatatttgccaccaccctggagtctagaccaacacacaaagatcctggctaaccctggcctatttagattccttcctctcacctggaccttcccatttcaatcatgcagatggtttctttttgtaaagagttccgtttgcctttcaatttttagagaaaataaagactgcattcatctcat

SEQ ID NO: 175486 - DNA, 3022 bp, Homo sapiens
  Payload ID: 14466
  Gene Symbol: RDH13
  Gene Name: retinol dehydrogenase 13 (all-trans/9-cis)
  ENST ID: ENST00000291892
  CDS Start-End: 802-1464
ctaagaaaggtagttcaggcagagttcagggaagatatctctgtgcagggccagacatggggatgagattctgataatttgggaatgaatcaggcccccagcccctcctccctcagactcagcagtccaggcacccggccctcctccctcggacccagaagtccatgctcccagcccctcctcccttggacccaggagtccaggcccccagcccctcctccctcagacccaggagtccaggcccccagccgccttctcctgcaggaccccaggagcttgggtacccacaggctactagatccttgtttctgtgcatggaaattctcaaattatctccaaaagtctatgaagaaggtaaacacacatttccagatgagggaataggctgatatagttgaaagacacacagagggtcacagtctggaattgacagtggtgggattcgaacctatttcactccagaactgcgtagcgccttatacgctgcggcaagtgtgacgtcattcgaacaaaccataggccccgcccccggactagccacgcccacaggctcctgaaaccaccaatcccagctgtgacagcgctcaggaccgatgctcataggtcccgtccctaggatccccgccccctccgcccgcgccccgcccctcgcagcccagttccggacgcgggcccagccgcgcctgcgcctccgctcgcctgtggctgcgtcgcgcgctcttcctcggagctacccaggcggctggtgtgcagcaagctccgcgccgacccctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggtgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctgatgggaggccaaacggtggatccagaacagagtcagcaaaagtagagcatgtggaccacgctgcccgcttctggtgcctgaagcagacatcactaatcgatcgttcttctgaggattgtctgttcatcccaggtggtctagtctgcctggatcagatgtccttccctgctgctgttgggcaggcagctcagccttttggctccagccagctctggtgtgactgtcaacgccctgcaccccggcgtggccaggacagagctgggcagacacacgggcatccatggctccaccttctccagcaccacactcggtgagtcccctcccagcctggggtctccacgtggagccctccacccctgctttctcagcccagggcccaggaccctccctcagagaccgtccctgaggcctcatgcctgctcctcgcctacgtcttctgaggcacagagcacaggtccctttcctccgttgacctggcctgccagcctctaacagccccgggaagcaggcagagccctgctggcggatgagaaaaccgtgtctcagaggaagaggccgtggagctgacgcctggagtcaggctgtactcaggggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcattt

SEQ ID NO: 175487 - DNA, 1987 bp, Homo sapiens
  Payload ID: 14466
  Gene Symbol: RDH13
  Gene Name: retinol dehydrogenase 13 (all-trans/9-cis)
  Uniprot ID: Q8NBN7
  ENST ID: ENST00000396247
  CDS Start-End: 474-1256
gttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcggaatttcactctgtcgccaggctggaatgcagtagggcaatctcggctcactgcaacctccacctcccgagttcaagtgatgctcctgcttcggcctcctgagtagctgggactacagggactatgtcaccggtggggcttgccccagcaaggccaccatccctgggaagacggtcatcgtgacgggtgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcattt

SEQ ID NO: 175488 - DNA, 1871 bp, Homo sapiens
  Payload ID: 14466
  Gene Symbol: RDH13
  Gene Name: retinol dehydrogenase 13 (all-trans/9-cis)
  Uniprot ID: Q8NBN7
  ENST ID: ENST00000415061
  CDS Start-End: 145-1140
agttccggacgcgggcccagccgcgcctgcgcctccgctcgcctgtggctgcgtcgcgcgctcttcctcggagctacccaggcggctggtgtgcagcaagctccgcgccgacccctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggtgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcattt

SEQ ID NO: 175489 - DNA, 1481 bp, Homo sapiens
  Payload ID: 14466
  Gene Symbol: RDH13
  Gene Name: retinol dehydrogenase 13 (all-trans/9-cis)
  ENST ID: ENST00000592573
  CDS Start-End: 55-717
gtgcagcaagctccgcgccgacccctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggtgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctgatgggaggccaaacggtggatccagaacagagtcagcaaaagtagagcatgtggaccacgctgcccgcttctggtgcctgaagcagacatcactaatcgatcgttcttctgaggattgtctgttcatcccaggtggtctagtctgcctggatcagatgtccttccctgctgctgttgggcaggcagctcagccttttggctccagccagctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagca

SEQ ID NO: 175490 - DNA, 601 bp, Homo sapiens
  Payload ID: 14466
  Gene Symbol: RDH13
  Gene Name: retinol dehydrogenase 13 (all-trans/9-cis)
  ENST ID: ENST00000586945
  CDS Start-End: 475-601
gttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcggaatctcactctgtcacccaggctggagtgcagaggtgtggtctcggctcactgcaacttccgcctcccaggctcaagcgattctcctgcctcagccttccgagtagctgggactacagggactatgtcaccggtggggcttgccccagcaaggccaccatccctgggaagacggtcatcgtgacgggtgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaag

SEQ ID NO: 175491 - DNA, 731 bp, Homo sapiens
  Payload ID: 14466
  Gene Symbol: RDH13
  Gene Name: retinol dehydrogenase 13 (all-trans/9-cis)
  ENST ID: ENST00000587721
  CDS Start-End: 117-224
gcgcctccgctcgcctgtggctgcgtcgcgcgctcttcctcggagctacccaggcggctggtgtgcagcaagctccgcgccgacccctgacgcctgacgcctgtccccggcccggcatgagccgctacctgctgccgctgtcggcgctgggcacggtagcaggcgccgccgtgctgctcaagaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatgg

SEQ ID NO: 175492 - DNA, 610 bp, Homo sapiens
  Payload ID: 14466
  Gene Symbol: RDH13
  Gene Name: retinol dehydrogenase 13 (all-trans/9-cis)
  ENST ID: ENST00000587026
  CDS Start-End: 523-610
gagacagtcacgttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcggaatctcactctgtcacccaggctggagtgcagaggtgtggtctcggctcactgcaacttccgcctcccaggctcaagcgattctcctgcctcagccttccgagtagctgggactacaggatccccgccccctccgcccgcgccccgcccctcgcagcccagttccggacgcgggcccagccgcgcctgcgcctccgctcgcctgtggctgcgtcgcgcgctcttcctcggagctacccaggcggctggtgtgcagcaagctccgcgccgacccctgacgcctgacgcctgtccccggcccggcatgagccgctacctgctgccgctgtcggcgctgggcacggtagcaggcgccgccgtgctgctcaaggactatgtcaccggtggggctt

SEQ ID NO: 175493 - DNA, 1328 bp, Homo sapiens
  Payload ID: 14466
  Gene Symbol: RDH13
  Gene Name: retinol dehydrogenase 13 (all-trans/9-cis)
  ENST ID: ENST00000591960
  CDS Start-End: 45-152
ctccgcgccgacccctgacgcctgacgcctgtccccggcccggcatgagccgctacctgctgccgctgtcggcgctgggcacggtagcaggcgccgccgtgctgctcaagaggcaacatcatcctggcctgccgagacatggagaagtgtgaggcggcagcaaaggacatccgcggggagaccctcaatcaccatgtcaacgcccggcacctggacttggcttccctcaagtctatccgagagaagcgttctgggcttttcctgttgtgcagtgtggaagtgctctatcttcattcatatcaaggaaagtcaaaggacaaactaaagccggcagcgtctttctggcttcctagtcaggctgttcggtagcggagtgtcaccctgatttccagccccgcagcacacacagtgagagcctgcctggcgtgattcagaggcaacgtatttcccaaggtggctgtgaaggaaccagggggataaacacagcccgtgaaccgcacgccagaggacaggtccggctgcctgccgcggagtcgtcacggcgtgtcgcgtctgagcgcttctccaaagcacccaagtggcacccggggtgacagttacatcatcttgagtacagttctctcaaggaaaaagcaagcccagcatcttctgccatggcaaccctggcttggagcctccataagagagaaggccctaagaataataccattttcttgctctaagttgctcttacgggaaagaagtgataatattcttcctaaacgccatcattcgtgcatccttcccacctatatgtgtcaccggatcattctccgcctgggcggggccgtcctgtgcactgcagaatgctgagcagtgtccttggcttcgaccgaccacatgccaggagcaccccaatttctgccatcgggtgattgacttcactgttgcatttgattttttatgtatcttttaaaaggacccaatagggccaggcacagtggctcacacttgtaatcccatagctgggattacaggcacctgccaccatgcccggctaatttaacgcccagctaatttttgtatttttagtagagatggggtttcaccatgttaaccaggctggtctcggactcctgacctcaggtgatccgcccgcctcggcctcccaaagtgctgggattacaggcgtgagccactgtgcctggctgatttttattcttttagttaaggctggttgatattaccttgtgtgtatataccacatgttgtttatccattgttgttgatggacatgtgggtggtttcaccttttggctattgtgaataaagctgctatgaacactgtg

SEQ ID NO: 175494 - DNA, 1871 bp, Homo sapiens; identical to SEQ ID NO: 175488
  Payload ID: 14466
  Gene Symbol: RDH13
  Gene Name: retinol dehydrogenase 13 (all-trans/9-cis)
  Uniprot ID: Q8NBN7
  ENST ID: ENST00000615256
  CDS Start-End: 145-1140

SEQ ID NO: 175495 - DNA, 1328 bp, Homo sapiens; identical to SEQ ID NO: 175493
  Payload ID: 14466
  Gene Symbol: RDH13
  Gene Name: retinol dehydrogenase 13 (all-trans/9-cis)
  ENST ID: ENST00000622337
  CDS Start-End: 45-152

SEQ ID NO: 175496 - DNA, 1931 bp, Homo sapiens
  Payload ID: 14466
  Gene Symbol: RDH13
  Gene Name: retinol dehydrogenase 13 (all-trans/9-cis)
  Uniprot ID: Q8NBN7
  ENST ID: ENST00000610356
  CDS Start-End: 399-1181
gatccccgccccctccgcccgcgccccgcccctcgcagcccagttccggacgcgggcccagccgcgcctgcgcctccgctcgcctgtggctgcgtcgcgcgctcttcctcggagctacccaggcggctggtgtgcagcaagctccgcgccgacccctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggtgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaag

SEQ ID NO: 175497 - DNA, 1931 bp, Homo sapiens; identical to SEQ ID NO: 175496
  Payload ID: 14466
  Gene Symbol: RDH13
  Gene Name: retinol dehydrogenase 13 (all-trans/9-cis)
  ENST ID: ENST00000616348
  CDS Start-End: 399-1181

SEQ ID NO: 175498 - DNA, 731 bp, Homo sapiens; identical to SEQ ID NO: 175491
  Payload ID: 14466
  Gene Symbol: RDH13
  Gene Name: retinol dehydrogenase 13 (all-trans/9-cis)
  ENST ID: ENST00000614875
  CDS Start-End: 117-224

SEQ ID NO: 175499 - DNA, 601 bp, Homo sapiens; identical to SEQ ID NO: 175490
  Payload ID: 14466
  Gene Symbol: RDH13
  Gene Name: retinol dehydrogenase 13 (all-trans/9-cis)
  ENST ID: ENST00000616988
  CDS Start-End: 475-601

SEQ ID NO: 175500 - DNA, 1931 bp, Homo sapiens; identical to SEQ ID NO: 175496
  Payload ID: 14466
  Gene Symbol: RDH13
  Gene Name: retinol dehydrogenase 13 (all-trans/9-cis)
  ENST ID: ENST00000613257
  CDS Start-End: 399-1181

SEQ ID NO: 175501 - DNA, 1931 bp, Homo sapiens; identical to SEQ ID NO: 175496
  Payload ID: 14466
  Gene Symbol: RDH13
  Gene Name: retinol dehydrogenase 13 (all-trans/9-cis)
  Uniprot ID: Q8NBN7
  ENST ID: ENST00000621849
  CDS Start-End: 399-1181

SEQ ID NO: 175502 - DNA, 1481 bp, Homo sapiens; identical to SEQ ID NO: 175489
  Payload ID: 14466
  Gene Symbol: RDH13
  Gene Name: retinol dehydrogenase 13 (all-trans/9-cis)
  ENST ID: ENST00000621540
  CDS Start-End: 55-717

SEQ ID NO: 175503 - DNA, 1931 bp, Homo sapiens; identical to SEQ ID NO: 175496
  Payload ID: 14466
  Gene Symbol: RDH13
  Gene Name: retinol dehydrogenase 13 (all-trans/9-cis)
  ENST ID: ENST00000620423
  CDS Start-End: 399-1181

SEQ ID NO: 175504 - DNA, 610 bp, Homo sapiens; identical to SEQ ID NO: 175492
  Payload ID: 14466
  Gene Symbol: RDH13
  Gene Name: retinol dehydrogenase 13 (all-trans/9-cis)
  ENST ID: ENST00000616337
  CDS Start-End: 523-610

SEQ ID NO: 175505 - DNA, 1931 bp, Homo sapiens; identical to SEQ ID NO: 175496
  Payload ID: 14466
  Gene Symbol: RDH13
  Gene Name: retinol dehydrogenase 13 (all-trans/9-cis)
  ENST ID: ENST00000615688
  CDS Start-End: 399-1181

SEQ ID NO: 175506 - DNA, 1931 bp, Homo sapiens; identical to SEQ ID NO: 175496
  Payload ID: 14466
  Gene Symbol: RDH13
  Gene Name: retinol dehydrogenase 13 (all-trans/9-cis)
  ENST ID: ENST00000613935
  CDS Start-End: 399-1181

SEQ ID NO: 175507 - DNA, 3022 bp, Homo sapiens; identical to SEQ ID NO: 175486
  Payload ID: 14466
  Gene Symbol: RDH13
  Gene Name: retinol dehydrogenase 13 (all-trans/9-cis)
  ENST ID: ENST00000622096
  CDS Start-End: 802-1464

SEQ ID NO: 175508 - DNA, 1931 bp, Homo sapiens; identical to SEQ ID NO: 175496
  Payload ID: 14466
  Gene Symbol: RDH13
  Gene Name: retinol dehydrogenase 13 (all-trans/9-cis)
  ENST ID: ENST00000622200
  CDS Start-End: 399-1181

SEQ ID NO: 175509 - DNA, 1931 bp, Homo sapiens; identical to SEQ ID NO: 175496
  Payload ID: 14466
  Gene Symbol: RDH13
  Gene Name: retinol dehydrogenase 13 (all-trans/9-cis)
  ENST ID: ENST00000622572
  CDS Start-End: 399-1181

SEQ ID NO: 175510 - DNA, 1987 bp, Homo sapiens; identical to SEQ ID NO: 175487
  Payload ID: 14466
  Gene Symbol: RDH13
  Gene Name: retinol dehydrogenase 13 (all-trans/9-cis)
  Uniprot ID: Q8NBN7
  ENST ID: ENST00000621614
  CDS Start-End: 474-1256

SEQ ID NO: 175511 - DNA, 1587 bp, Homo sapiens
  Payload ID: 14467
  Gene Symbol: RDH14
  Gene Name: retinol dehydrogenase 14 (all-trans/9-cis/11-cis)
  Uniprot ID: Q9HBH5
  ENST ID: ENST00000381249
  CDS Start-End: 109-1119
gacccgccgcgccccagcgttctccgcgtacaggtggtctcttgggttccggtaaggcggcggctgcggaactcccgtggaggggccggtgggccctcgggcctgacgatggcagtggccactgcggcggcagtactggccgctctgggcggggcgctgtggctggcggcccgccggttcgtggggcccagggtccagcggctgcgcagaggcggggaccccggcctcatgcacgggaagactgtgctgatcaccggggcgaacagcggcctgggccgcgccacggccgccgagctactgcgcctgggagcgcgggtgatcatgggctgccgggaccgcgcgcgcgccgaggaggcggcgggtcagctccgccgcgagctccgccaggccgcggagtgcggcccagagcctggcgtcagcggggtgggcgagctcatagtccgggagctggacctcgcctcgctgcgctcggtgcgcgccttctgccaggaaatgctccaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccggagcaaactggctaacattctttttaccagggaactagcccgccgcttagaaggcacaaatgtcaccgtcaatgtgttgcatcctggtattgtacggacaaatctggggaggcacatacacattccactgttggtcaaaccactcttcaatttggtgtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtacaaattcttaa

SEQ ID NO: 175512 - DNA, 2409 bp, Homo sapiens
  Payload ID: 14468
  Gene Symbol: RDH16
  Gene Name: retinol dehydrogenase 16 (all-trans)
  Uniprot ID: O75452
  ENST ID: ENST00000398138
  CDS Start-End: 858-1811
atcacccattttctgcatcagtcacactgggagctgcagaccggagctgttcctatttgcccatcctctccctgctttctttacctctgaggttggattctccctgtgggatcctgcaatccttctgccccaaaaaactattatagcaggagggaacctgttcctgctcactctttgccttctccttctcatcctagacagcctgaccgtgccctagttttcagaggagtgattgattctggggtgcggagcaggatgaggaaactcaggctcagagagggatttccacctaatgtgcctggaaaccatgggtagctacccaataaggcctttctatgttcagaaggtcatggaccaggagtgttggtatcggagctttgtagagacagttttgacccctgtacttagagcagaggggtgtgtttgccatggagagtgtgtgtgggcagctgtgtgtaagcctgtgtgagttctgtgtatgttcctgtgtgaatatatgtgtgtgctccttcatggacacagcatgcatgtagtgggcatagcaaggcagagagaaatcaggagactaggggcacattgcccagtaggaagatagtatcttcctactgggcaggacttgaggtgtgcaaaggtgtgcatgagtactgcaaaagcagttcaaagagcagagaggtggggccagaataaatatgttgcagaaaggcagtcatcagggaggaaagtgaggattccctgccaaaatgcctgagggcttccctgcctaccacagccctctgtgttcttaaatcctcctgtctgaacagaggccagactctggtttcccccacagcctgtctgtgtctgtcctctgcaaagccatgtggctctacctggcggttttcgtgggcctgtactaccttctgcactggtaccgggagaggcaggtgctgagccacctgagagataagtatgtgttcatcacgggctgtgactctggcttcgggaaactgctggccagacagctggatgcacgaggcttgcgggtgctggctgcatgtctgacggagaaaggagccgagcagctgaggggccagacttcagacaggctggagacggtgaccctggatgttaccaagacagagagcgttgctgcagccgcccagtgggtgaaggagtgcgtgagagacaaaggactctggggcctggtgaataatgctggcatctccttgcccacggctcccaatgagttgctcaccaagcaggacttcgtgaccatactggacgtgaacttgttgggggtgattgatgtgactctgagcctgctgcccttagtgaggagggccaggggccgtgtggtcaacgtctccagtgtcatgggccgggtgtcactttttggtggaggctactgcatctccaagtatggcgtggaagccttctctgactccctcaggagggaactctcctactttggggtgaaggtggctatgattgaacctggctatttcaagactgctgtgaccagtaaggagagattcttaaagagcttcctggagatttgggaccggtccagtccagaggtcaaggaggcctatggcgagaagtttgttgcagactataagaaatcagctgaacaaatggagcagaagtgcacacaggatctgtcgttggtgaccaactgcatggagcatgcgctgattgcctgccacccccgtactcgctactcagctggctgggatgccaagcttctctacctccccatgagctacatgcccaccttcctggtggatgccattatgtactgggtctctccaagcccggccaaggctctatgaagctaaggttggatgcatggttgcatggatttggggtgtgctatgaggggtggtgtatccttgggagagatataaagtggagggagggagccgtccggtcagtagggcaccaatcccacctccttcattacctcctggccatgattctcctgggagataattctgctctctggagatgttggtaggaaagtttcaagttacgcagctgagaaacagggaccaaatagtgctcctgggtgcattgtcaccgtgggtggccactcaagggtccaagcctctagggccatccttgggctaacaactggggtgggtgtgagcaggtggaaggagcctcagcccatgccattacctcctgcttccttatcaggctgtgtgttaattctgggccagtctacaccctcccacggggtggaaatggcctggaggatgtgagggcacccctcctctgaagatccctgtacacgtggtgttgggactggaaccattatgcggccccataggcctcaggagtcatcccagaagcagtggctgggaggtggtgtcctaagtaaggatctgtgcagaggacaaataaatcagtttttgatttgtcttgaaa

SEQ ID NO: 175513 - DNA, 1269 bp, Homo sapiens
  Payload ID: 14469
  Gene Symbol: RDH5
  Gene Name: retinol dehydrogenase 5 (11-cis/9-cis)
  Uniprot ID: Q92781
  ENST ID: ENST00000257895
  CDS Start-End: 153-1109
ggactttggccttagcagtagttagtgtgggaggctgggaagactgggagcagtctcttaaacaaaagcaaaagaataagcttcgggcgctgtagtacctgccagctttcgccacaggaggctgccacctgtaggtcacttgggctccagctatgtggctgcctcttctgctgggtgccttactctgggcagtgctgtggttgctcagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtggaa

SEQ ID NO: 175514 - DNA, 1259 bp, Homo sapiens
  Payload ID: 14469
  Gene Symbol: RDH5
  Gene Name: retinol dehydrogenase 5 (11-cis/9-cis)
  Uniprot ID: Q92781
  ENST ID: ENST00000548082
  CDS Start-End: 143-1099
cagtagttagtgtgggaggctgggaagactgggagcagtctcttaaacaaaagcaaaagaataagcttcgggcgctgtagtacctgccagctttcgccacaggagcctaggctgccacctgtaggtcacttgggctccagctatgtggctgcctcttctgctgggtgccttactctgggcagtgctgtggttgctcagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtggaa

SEQ ID NO: 175515 - DNA, 581 bp, Homo sapiens
  Payload ID: 14469
  Gene Symbol: RDH5
  Gene Name: retinol dehydrogenase 5 (11-cis/9-cis)
  ENST ID: ENST00000548123
  CDS Start-End: 1-311
ctcttctgctgggtgccttactctgggcagtgctgtggttgctcagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtacctgaaaatgcaacagcgcatcatgaacctgatctgtgacccggacctaaccaaggtgagccgatgcctggagcatgccctgactgctcgacacccccgaacccgctacagcccag

SEQ ID NO: 175516 - DNA, 527 bp, Homo sapiens
  Payload ID: 14469
  Gene Symbol: RDH5
  Gene Name: retinol dehydrogenase 5 (11-cis/9-cis)
  ENST ID: ENST00000552930
  CDS Start-End: 361-527
actccggactttggccttagcagtagttagtgtgggaggctgggaagactgggagcagtctcttaaacaaaagcaaaagaataagcttcgggcgctgtagtacctgccagctttcgccacaggagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagca

SEQ ID NO: 175517 - DNA, 1054 bp, Homo sapiens
  Payload ID: 14469
  Gene Symbol: RDH5
  Gene Name: retinol dehydrogenase 5 (11-cis/9-cis)
  ENST ID: ENST00000547072
  CDS Start-End: 328-993
aatacgcctggcatccaagtccacccactccggactttggccttagcagtagttagtgtgggaggctgggaagactgggagcagtctcttaaacaaaagcaaaagaataagcttcgggcgctgtagtacctgccagctttcgccacaggaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccc

SEQ ID NO: 175518 - DNA, 702 bp, Homo sapiens
  Payload ID: 14470
  Gene Symbol: RDH8
  Gene Name: retinol dehydrogenase 8 (all-trans)
  ENST ID: ENST00000587782
  CDS Start-End: 1-238
cttcgaaagcctcgctatccagctgctgcagttcaacatcttgtttctatggctgagttcccaggcactgaccctgagaccctgcactacttccgggacctctatctcccagcctccaggaagctgttttgctccgtgggacagaacccacaggacgtggttcaggccattgtcaacgtcatcagctcgactcgaccacccctgcgccgacagaccaacatccgctactcgccgctgaccacgctcaaaaccgtggattcctctggcagcctgtatgtgcgaacgacccaccgcctcctcttccgctgtccacgcctcctcaaccttggccttcaatgtctgtcctgcggctgcctcccaacgcgggtgcggccaagatgagcagaacagagcttcacgatccccatccctgaacaaccagacctcttcattccacatctaattcaaaggatgaacagactcttcatttattcattctgcaaactccccctcccctcctctgtgcctagacatggctagaatcccagaagggcctttattttcaggcatagactcctctgtggtcacagctggagcacagagagggaccctgggaacttggcctgggaagcccagagcaggaagccacagctgtctctgggaaagcaagggaggcttcctggaggaagcggcattgttatgagccttgaaggaagagacaga

SEQ ID NO: 175519 - DNA, 1715 bp, Homo sapiens
  Payload ID: 14470
  Gene Symbol: RDH8
  Gene Name: retinol dehydrogenase 8 (all-trans)
  ENST ID: ENST00000591589
  CDS Start-End: 190-1185
tgtctatagtaggtgcggagaagaaatgtttggcagatgaagaaaatgaggtgcagagaggatttaagagattctctcttactgcctgttcagggtcagtccagaattgagggtctccgggggagggcagaggctttgccctgcaggggatctgtgggagggggttaggagggagcagatgagcccaggatgaatggtcagagtcaggtgctgcccggcggaggtcacgagtccagggaggggatcaacatggccgctgcaccccggactgtgttgatctccggctgctcatcaggaattggtctggaacttgcagtgcaactggcccatgaccccaagaagcgctaccaggtcgtggccaccatgagggacctggggaagaaggagacactggaggcagctgctggggaggctctggggcagaccctcaccgtggcccagctggacgtgtgcagtgatgagtcggtggcccagtgtctcagctgtatccagggagaagtggacgtgctggtgaataatgctggaatgggcctggtggggcccctggaggggctcagccttgctgccatgcagaatgtctttgacaccaactttttcggagctgtccgtctcgtcaaagctgtgcttccaggcatgaagaggaggcggcagggccacatcgtggtgatcagcagtgtcatgggcctgcagggtgtcatcttcaacgatgtctatgcagcttccaagttcgccctggagggattcttcgaaagcctcgctatccagctgctgcagttcaacatcttcatctccctggtggagccaggccccgtggtcaccgagtttgaggggaagcttctggcgcaggtttctatggctgagttcccaggcactgaccctgagaccctgcactacttccgggacctctatctcccagcctccaggaagctgttttgctccgtgggacagaacccacaggacgtggttcaggccattgtcaacgtcatcagctcgactcgaccacccctgcgccgacagaccaacatccgctactcgccgctgaccacgctcaaaaccgtggattcctctggcagcctgtatgtgcgaacgacccaccgcctcctcttccgctgtccacgcctcctcaaccttggccttcaatgtctgtcctgcggctgcctcccaacgcgggtgcggccaagatgagcagaacagagcttcacgatccccatccctgaacaaccagacctcttcattccacatctaattcaaaggatgaacagactcttcatttattcattctgcaaactccccctcccctcctctgtgcctagacatggctagaatcccagaagggcctttattttcaggcatagactcctctgtggtcacagctggagcacagagagggaccctgggaacttggcctgggaagcccagagcaggaagccacagctgtctctgggaaagcaagggaggcttcctggaggaagcggcattgttatgagccttgaaggaagagacagactctgctacattcaacctcgtgacttcatgatcctgggcctgagaacacaggaatgattcatagcccaccccccacctccatgcatacaccagagctctgtggaccaaggggtcattcctggtcacacactccatcagcaaaatgtatttgagcacacaccagcaatgtatgtatattttttccattaaatatatatttataaccacaa

SEQ ID NO: 175520 - DNA, 3100 bp, Homo sapiens
  Payload ID: 14471
  Gene Symbol: RETSAT
  Gene Name: retinol saturase (all-trans-retinol 13,14-reductase)
  Uniprot ID: Q6NUM9
  ENST ID: ENST00000295802
  CDS Start-End: 114-1946
tcaaagctgcctccgcctcctgactggagagcgaactagcccgggcggagccacagtcctagaggctgagcgcagtcggagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcgtggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaacatttgaaa

SEQ ID NO: 175521 - DNA, 765 bp, Homo sapiens
  Payload ID: 14471
  Gene Symbol: RETSAT
  Gene Name: retinol saturase (all-trans-retinol 13,14-reductase)
  ENST ID: ENST00000409984
  CDS Start-End: 1-765
tgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaa

SEQ ID NO: 175522 - DNA, 2335 bp, Homo sapiens
  Payload ID: 14471
  Gene Symbol: RETSAT
  Gene Name: retinol saturase (all-trans-retinol 13,14-reductase)
  ENST ID: ENST00000429806
  CDS Start-End: 1-961
tggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcgtggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaacatttgaaa

SEQ ID NO: 175523 - DNA, 1759 bp, Homo sapiens
  Payload ID: 14471
  Gene Symbol: RETSAT
  Gene Name: retinol saturase (all-trans-retinol 13,14-reductase)
  ENST ID: ENST00000449375
  CDS Start-End: 1-1199
ttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaaggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcgtggttttggttgccattccataggtttggagagctctagatctcttttgtgctgggttcagtggctcttcag

SEQ ID NO: 175524 - DNA, 1500 bp, Homo sapiens
  Payload ID: 14471
  Gene Symbol: RETSAT
  Gene Name: retinol saturase (all-trans-retinol 13,14-reductase)
  ENST ID: ENST00000438611
  CDS Start-End: 1-421
cttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtaaaaggcgggtctgcactgcccctcttgcaggttccccaatgtgtccccttctggagccaacctgctccgtgtgggtcatgcttctcctcttcttggccggccctctgattgtccttaagcaacaaggtgagaacgctacctctaacatcatcctaaccctagcatttaatgttggggaaactgaggcccatacagattaattacagtcctgaggccactcagctgaaaggggcagggctgagcagagtagctggtctgatttgaaagctccgctcctcccacccttctgggctgagggggcttccagagaagaggcctcaggaagagaagcaggagagcaggcagcccacagggagcagagccgccgagccaacgcagctaagaggtcccgccaccttcatgtaactggatctgaggaagggaggccgctgggaagaggggaccagtaacccagcaggggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgac

SEQ ID NO: 175525 - DNA, 2810 bp, Homo sapiens
  Payload ID: 14472
  Gene Symbol: RS1
  Gene Name: retinoschisin 1
  Uniprot ID: O15537
  ENST ID: ENST00000379984
  CDS Start-End: 42-716
cagttcagtaaggtagagctttggccgaggacgaggggaagatgtcacgcaagatagaaggctttttgttattacttctctttggctatgaagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgatgcctgcctcagctcggcgcctgccagggggtgactggcacagagcgggccgtaggggaccccctcacacaccaccgagatggacagggctatatttcgcaaagcaattgtaactgcagtgctgggtagataatttttttttttttaagatatagctttctgatttcaatgaaataaaaatgaacttattccccactcagggccagagaaagtcagaacaaagaaaatgtccccgaaacgaattttcttacaaaagcctaagtagcaggggtaattttctgctcattttttgtctcagtgatactgtgaaaggtgcagtctcaggggaacacaaagcagccctgataatttgaaaattcatttgctttaccacattcaagacagaaacatacagtttcctaaagcctggctttgaatgcagaagggagcagctcctcctagttaagtttccactaaatcatcgccaaagaggacttcagagccctggggaggcagctgagggtctcaagggtgactgggtggcagggatgagtgcggtgggtgagaatcccggtgccctgagaggctatacgtgacaaatgaccaaaagcccaaggtaggggagtttcctctgctcacagttcttaccttcaaggcggatctgggcttccaccctcatgaacacagggattggggagggaccagagcgcccaatacacacagctccattatgcaatccattccagcaaattccccgtgtctgtggtcaccatttaggtgatcatacaggacaggctgcacatctcagtatatgtagggaccccaaatgaccacaacacagtacaattgccctttacctagggctaccatttcctagcaaaccaaacatagttcgagaacagctggcccaggagctaccactggctactcagaggaggctcattagctggctacatgcttcgcaggaagtgggaaggactcacatcataaaaaggaccatgtagctttttccctgaaagcttctcaccctccaccctctgccttgcaatacgcaaactgcgcctgctcctgaaaagctctctgggaaggaatgggcctggctttccgttcctggaggcggcgccttagattgggaggcctcattggccacttagagcgcagcctgagtttccaggccccttcctgggagaggctgttaacacgggggaggggcaggagagggatatggagagcaggtggtggaatcagaggacgaggctgctctaaagactgttctggccccagacacagggtagtctttgctagcagctcatttccgagttacttttcattttcaaatgccaaggcaagtgactagactcgcgctaatacagtgctggacaacacattcaccttttctgtgaacaggcagccttctaaaagccccaaacatccttcttgatgctttgggggctcaattattttatatccaacccagcatctttctagtccctatgctgtatgcttgaacttcggaaaatgcttttccccgcccaatcttctctcaaatataaacacatcacacagggtgttgggggtggggggggggggtggggggacttatccctggccttaggacacaggacaaatctattttggatagaaatgcctgaacagagacccttatttggaaaggtgaattaactttggtcacgacatggactgtcagacaaaatggcagtatcctaagagttaaggcacatcaaacacaggagtcgagagagtgcagttcagggaaaaaggagaggaggaaacagtgaggcagggagaaaggctttccaaataagagttcatgttggaaacttttgtcacggctttattgagattaagttcacatacaatttgtatccatttaaagtgtacaatttgatgacttttggtatattcagagttgtgcaaccattatcactagatcaattttagaaagtttatcaccccaaagagaaatcctgcacccatcagccaacactccccaacccatcggccaccccaagccctctgcaaccacgaatcgactgtctctgtagattggccttctggacgttctacataaatgaaatcatatagtatgtggta

SEQ ID NO: 175526 - DNA, 5426 bp, Homo sapiens
  Payload ID: 14473
  Gene Symbol: RGAG1
  Gene Name: retrotransposon gag domain containing 1
  Uniprot ID: Q8NET4
  ENST ID: ENST00000465301
  CDS Start-End: 247-4413
ggcaaagggcctcagccccgccctactgactgtgaattctacaacatatggagcgcctaccttgtgcaaggcattgtggcccttcagagacttgaagacagtgtgtgactctcctgtgagttaagagcactggctgagtcagacagacccgagtgacaagcccagcttcgctccctctcagcggtgagagccaagattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtccccacccctaatgccagcctcagactctggggcactttccccattgctaatgccagcctcagactctggggcactgtccccattgctaatgccagccttagattctggaacattgtccccattgctgtccacttcagagtatggggtaatgtccccagggatgatgacaattcctgattttggaacgatgtccgcaacgctaatggtagcaccagattctgcagagatatcaccattggcaatgccagctccatcctctggagtggtgtgtacacctataatgagcacttcatcctctgaggcaatgtccacaccattaatgctagccccagattctggagagttatccccaattctaatgcaagatatgaatcctggagtgatgtctacacagccagtgccagctcccagctctgaggcaatgtccccattgcaaattacagatgaagacaccgaagcaatgtccaaagtgctaatgactgctctagcctctggagagatatcttcgctgctaatgtcaggcacggactctgaagcaatatcctcactgataatgtcagctgtagcttctggaggtacatcaccccagccaacaagcacccaaaactctgggggaatacctaccccgctcatgtcagatctagactctggaataatgtcatcgcttttaatgtcatctccaggctctgaagtaatgtccacaccgctactgtcagtcccagatgctggagaaatgtccacattaccaaagccagctccagatgctgaagcaatgtccccagcactaatgacggccctaccctctggagtgatgcccacccaaacgatgccagccccaggctctggggcgatgtccccatggtcaacacaaaatgtagactctgaaatgatgtctaatccgccagtgagagcaacagcctctggggtgatgtctgcaccaccagtaagagctttagattctggagcaatgtccacaccgctaatgggagccccagcctctggaaatatgtctacattgcaaaagacagttccagcctctggagccatgaccacctcactgatgacagtcccaagctctggagtgatgtccacagagcaaatgtcagccacagcctctagagtaatgtccgcacagttaacaatggccaaaacttctggagcaatgcccacaggctctatgaaagccgtggcaaaacaatacaagagagccacagcctctggaaagatgtccacgccactgaggagagctccaacttctggagcaatgtccacccaaccagttacggcaacagcctctgaaacaatgtccatgccacaattgacagtcccagcctctggatcaatgtccatgctgcaaatgagagcccctgtctctgaagcaatgtccatgccacaaatgagaaccatggcctcaggattgacatctgcagcacagatgaaagccatgacttctggagcaatgtccaccccactaatgacagcccaaacctctggatcaacatccacgctgttaatgagagacacagcctcaggagtgatgtcctgtccacaaatgagatctctggcctctggagcattgtccaagccactaatgacacccaaagcctcaggaacgatgttcacggagaaaatgacaaccacagcttctgaagcaatgcccacactgctaatgagagacacagtttctggagctctgtccatgccgcaaatgacagacacagcctctggagggttgtctgcatcgctaatgagagacacagcttctggagcaatgtccacatcacaaatgacagccacagtctctggagggatgtccatgccactaatgagagctcaagacccaggagtaatgcctgcctcactaatgagagccaaagtgtctggaaagatgctcagtcagccaatgagcacccaagatcctggagggatgtccatgtcgcccatgaagtccatgaccgctggagggatgcagatgaattccccaacctctgatgtgatgtccacaccaacagtgagagcctggacctctgaaacaatgtccacaccactaatgagaacctcagaccctggagagaggccctcactgctcacaagagcttcatcctctggagagatgtccctaccactaatgagagctccagcttctggagagatagccacgcctctgagatccccagcttatggagccatgtctgctccacaaatgacagccacagcctctggaatgatgtcatccatgccacaagtgaaggctcccatctctggagcaatgtccatgccactaacaagatccacagcctctggagggatgtccatgccactgatgagagccccagactctagagtgacatccacatcacaaatgatgcccacagcttctggagacatgtgcacactaccagtgcgagccccagcctctggaggggtgtcctcaccactagtaagagctccagcctctggaactatgtccacaccactaaggagaccctcagcctgtgagactgtgtccacagagttaatgagagcttcagcctctggacatatgtccactgcacaaacaacagccatggtctctggagggatgtccaagccattaatgagagccccggcctctggaacaatgcccatgcctttaatgtcagccatggcttctggagagatgtctatgccgctaatggaaaccatggcctctggagcaacgtccacattgcaaaccagtgttgcgaactctagatctatgtccttgtcacaaacaacatataccgtgtctggaaggatggccacagcgccaattagagcctctgcttctggagcaaggtccacatcatttatgagagcctcagtttctggatcgatgcccatgccactaccaagagccacagcctctggatgtggcatgggtatgtccatgccacaaatgacagccacagactctagagggatgtccacaccactaatgagggcctcaggccctggaacaatgtccacaccacagacagcctttggagtgatgtccactccggaaatcaaagccacagactctggagaggcatccacctctcacattaacatcacagcctctggatcaaagcccacatcgcacatgactgccacaactcctgaaactgcgaaaccaccaccaaaggaagtgccatccttcggaatgttgaccccagcactctgctacctcttagaagagcaggaagcagcccggggctcatgctctgtggaggaagagatggagattgatgaggagaagcaaatgaaggggtttttggacgattcagagagaatggcatttctggtatctcttcatctgggagcagcagagaggtggttcatcttgcaaatggaggtaggagaacctctctcacatgaaaataaatctttcctgagaagatcccagggcatatatgactccctatctgagatagacatcctcagtgctgttctttgccatcccaaacagggccaaaagtcagtcaggcagtatgccactgacttcctgctgctggcccgacatttgtcttggtctgatgccattctacggaccaggtttctggaaggactctcagaagctgttaccaccaaaatgggtcggatcttcctgaaggtggctggcagcctaaaggagctgatagacaggtctctgtacaccgagtgccagctggctgaagagaaggattccccaggcaactcaagccaggttctgccaacagcctgtaagcggaataatgaggaggccatggggaatgaactgagctctcagcagcagactgaggagcaccagcatgtttccaaacgctgttactacctgaaagagcatggagacccccaagaaggtcttcatgatcaccttggacagagcacaggccatcatcagaaggcccataccaacaagtaaaactccatggaatcttctcctgtgatatctgactcgaccgctaactggaggactggttcctggacccattccattaaactacattataaaccttgttgccttcacccttcagcctcccgctccaggcacatcccaccttacctctcacttggctgatttgaccttctctttcacccacatgcctaagacctgccctgacaatcagagtagggactacaagagtgtatggtgtatgaggttctgaactcccatcaccaccgaggccagtcctagttcttggtccagggagaagtctaggcaggataaatcatatcttacctcaaaaaacccttagcgtatcttgccatgtgtcagcaggcaaacttgaggaagccctggttctatttcacctggcaggggagcctataaggagagcgatgcccactcctataccacccttgtaacccagtagacttgccccatatgccccaactcatagcacctaaaatgggtctccagggtccttgccctgtttatagtatccatcctgaaccattcgttttgacccataataatagtgatagtataatggctaccagttattgataatgtatcatgtgacaggcattgggctaaactcttgacaagcaccatctcactacattcttacagtaacacaacttgttcttgtgttgtcagcttctgacctcttgatctgttgtttatggcctttgtcttgtccctcagtgggggttctctagctctgacctctgggtgaccccctcagttgttgattgctctcactccccttggctgttgtgcttcatggccagcactcttgatgagggtcttggtctataaacaggcatagatagctagaacataatgtgagcagtgtttgccttcaggtggtggggttatgggtagtttttattttcttccttctacttctctatacatttcagattctctacagtaagcatgtgttacatttgtaattataaaagtaagtaaacttcatttatgaaaaaaga

SEQ ID NO: 175527 - DNA, 532 bp, Homo sapiens
  Payload ID: 14473
  Gene Symbol: RGAG1
  Gene Name: retrotransposon gag domain containing 1
  ENST ID: ENST00000520821
  CDS Start-End: 269-532
ggaaaggagacgtgcccactggagagcaagtcagaactttcgtgagccctgctccaggtcccaggagaaagtgccagccatgaggactggagtattgcctgcccttcagagacttgaagacagtgtgtgactctcctgtgagttaagagcactggctgagtcagacagacccgagtgacaagcccagcttcgctccctctcagcggtgagagccaagattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtcc

SEQ ID NO: 175528 - DNA, 5225 bp, Homo sapiens
  Payload ID: 14473
  Gene Symbol: RGAG1
  Gene Name: retrotransposon gag domain containing 1
  Uniprot ID: Q8NET4
  ENST ID: ENST00000540313
  CDS Start-End: 54-4220
agattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtccccacccctaatgccagcctcagactctggggcactttccccattgctaatgccagcctcagactctggggcactgtccccattgctaatgccagccttagattctggaacattgtccccattgctgtccacttcagagtatggggtaatgtccccagggatgatgacaattcctgattttggaacgatgtccgcaacgctaatggtagcaccagattctgcagagatatcaccattggcaatgccagctccatcctctggagtggtgtgtacacctataatgagcacttcatcctctgaggcaatgtccacaccattaatgctagccccagattctggagagttatccccaattctaatgcaagatatgaatcctggagtgatgtctacacagccagtgccagctcccagctctgaggcaatgtccccattgcaaattacagatgaagacaccgaagcaatgtccaaagtgctaatgactgctctagcctctggagagatatcttcgctgctaatgtcaggcacggactctgaagcaatatcctcactgataatgtcagctgtagcttctggaggtacatcaccccagccaacaagcacccaaaactctgggggaatacctaccccgctcatgtcagatctagactctggaataatgtcatcgcttttaatgtcatctccaggctctgaagtaatgtccacaccgctactgtcagtcccagatgctggagaaatgtccacattaccaaagccagctccagatgctgaagcaatgtccccagcactaatgacggccctaccctctggagtgatgcccacccaaacgatgccagccccaggctctggggcgatgtccccatggtcaacacaaaatgtagactctgaaatgatgtctaatccgccagtgagagcaacagcctctggggtgatgtctgcaccaccagtaagagctttagattctggagcaatgtccacaccgctaatgggagccccagcctctggaaatatgtctacattgcaaaagacagttccagcctctggagccatgaccacctcactgatgacagtcccaagctctggagtgatgtccacagagcaaatgtcagccacagcctctagagtaatgtccgcacagttaacaatggccaaaacttctggagcaatgcccacaggctctatgaaagccgtggcaaaacaatacaagagagccacagcctctggaaagatgtccacgccactgaggagagctccaacttctggagcaatgtccacccaaccagttacggcaacagcctctgaaacaatgtccatgccacaattgacagtcccagcctctggatcaatgtccatgctgcaaatgagagcccctgtctctgaagcaatgtccatgccacaaatgagaaccatggcctcaggattgacatctgcagcacagatgaaagccatgacttctggagcaatgtccaccccactaatgacagcccaaacctctggatcaacatccacgctgttaatgagagacacagcctcaggagtgatgtcctgtccacaaatgagatctctggcctctggagcattgtccaagccactaatgacacccaaagcctcaggaacgatgttcacggagaaaatgacaaccacagcttctgaagcaatgcccacactgctaatgagagacacagtttctggagctctgtccatgccgcaaatgacagacacagcctctggagggttgtctgcatcgctaatgagagacacagcttctggagcaatgtccacatcacaaatgacagccacagtctctggagggatgtccatgccactaatgagagctcaagacccaggagtaatgcctgcctcactaatgagagccaaagtgtctggaaagatgctcagtcagccaatgagcacccaagatcctggagggatgtccatgtcgcccatgaagtccatgaccgctggagggatgcagatgaattccccaacctctgatgtgatgtccacaccaacagtgagagcctggacctctgaaacaatgtccacaccactaatgagaacctcagaccctggagagaggccctcactgctcacaagagcttcatcctctggagagatgtccctaccactaatgagagctccagcttctggagagatagccacgcctctgagatccccagcttatggagccatgtctgctccacaaatgacagccacagcctctggaatgatgtcatccatgccacaagtgaaggctcccatctctggagcaatgtccatgccactaacaagatccacagcctctggagggatgtccatgccactgatgagagccccagactctagagtgacatccacatcacaaatgatgcccacagcttctggagacatgtgcacactaccagtgcgagccccagcctctggaggggtgtcctcaccactagtaagagctccagcctctggaactatgtccacaccactaaggagaccctcagcctgtgagactgtgtccacagagttaatgagagcttcagcctctggacatatgtccactgcacaaacaacagccatggtctctggagggatgtccaagccattaatgagagccccggcctctggaacaatgcccatgcctttaatgtcagccatggcttctggagagatgtctatgccgctaatggaaaccatggcctctggagcaacgtccacattgcaaaccagtgttgcgaactctagatctatgtccttgtcacaaacaacatataccgtgtctggaaggatggccacagcgccaattagagcctctgcttctggagcaaggtccacatcatttatgagagcctcagtttctggatcgatgcccatgccactaccaagagccacagcctctggatgtggcatgggtatgtccatgccacaaatgacagccacagactctagagggatgtccacaccactaatgagggcctcaggccctggaacaatgtccacaccacagacagcctttggagtgatgtccactccggaaatcaaagccacagactctggagaggcatccacctctcacattaacatcacagcctctggatcaaagcccacatcgcacatgactgccacaactcctgaaactgcgaaaccaccaccaaaggaagtgccatccttcggaatgttgaccccagcactctgctacctcttagaagagcaggaagcagcccggggctcatgctctgtggaggaagagatggagattgatgaggagaagcaaatgaaggggtttttggacgattcagagagaatggcatttctggtatctcttcatctgggagcagcagagaggtggttcatcttgcaaatggaggtaggagaacctctctcacatgaaaataaatctttcctgagaagatcccagggcatatatgactccctatctgagatagacatcctcagtgctgttctttgccatcccaaacagggccaaaagtcagtcaggcagtatgccactgacttcctgctgctggcccgacatttgtcttggtctgatgccattctacggaccaggtttctggaaggactctcagaagctgttaccaccaaaatgggtcggatcttcctgaaggtggctggcagcctaaaggagctgatagacaggtctctgtacaccgagtgccagctggctgaagagaaggattccccaggcaactcaagccaggttctgccaacagcctgtaagcggaataatgaggaggccatggggaatgaactgagctctcagcagcagactgaggagcaccagcatgtttccaaacgctgttactacctgaaagagcatggagacccccaagaaggtcttcatgatcaccttggacagagcacaggccatcatcagaaggcccataccaacaagtaaaactccatggaatcttctcctgtgatatctgactcgaccgctaactggaggactggttcctggacccattccattaaactacattataaaccttgttgccttcacccttcagcctcccgctccaggcacatcccaccttacctctcacttggctgatttgaccttctctttcacccacatgcctaagacctgccctgacaatcagagtagggactacaagagtgtatggtgtatgaggttctgaactcccatcaccaccgaggccagtcctagttcttggtccagggagaagtctaggcaggataaatcatatcttacctcaaaaaacccttagcgtatcttgccatgtgtcagcaggcaaacttgaggaagccctggttctatttcacctggcaggggagcctataaggagagcgatgcccactcctataccacccttgtaacccagtagacttgccccatatgccccaactcatagcacctaaaatgggtctccagggtccttgccctgtttatagtatccatcctgaaccattcgttttgacccataataatagtgatagtataatggctaccagttattgataatgtatcatgtgacaggcattgggctaaactcttgacaagcaccatctcactacattcttacagtaacacaacttgttcttgtgttgtcagcttctgacctcttgatctgttgtttatggcctttgtcttgtccctcagtgggggttctctagctctgacctctgggtgaccccctcagttgttgattgctctcactccccttggctgttgtgcttcatggccagcactcttgatgagggtcttggtctataaacaggcatagatagctagaacataatgtgagcagtgtttgccttcaggtggtggggttatgggtagtttttattttcttccttctacttctctatacatttcagattctctacagtaagcatgtgttacatttgtaattataaaagtaagtaaacttcatttatg

SEQ ID NO: 175529 - DNA, 4339 bp, Homo sapiens
  Payload ID: 14474
  Gene Symbol: RGAG4
  Gene Name: retrotransposon gag domain containing 4
  Uniprot ID: Q5HYW3
  ENST ID: ENST00000479991
  CDS Start-End: 362-2071
ccgcagtccgctccctcccgctccgctcgcccctgcccgcccgcccgcccggtcgcgcggtcgccgccgccaccgtgtcgcccgcatcctccgcctggcgcctccgggccccgtgcctccgcccgccctctccggccccggcgacgaggtaacgcgccctgggccgagccgccgggccctccgcccagagcgccgccctccgagctcgccccggtgggtgtggcccggcctggcccgtgccccgctgccgcacttcggtccctcccgagccccgccgccgcatttcggcctcctccggccgcccgtagttccagttcccctttccccaccacggagccccagggcccctgggcttgtcgagatgtctgaggcgtcaggaaatctcaacagcctccgcatggcgaatgtggccctgcgcgaagaattaaatgcccttcgcggggagaatgccaatttgggcctccagctcgggagagccctggccgaggttaattccttgcggggcaatgtctccagctacatccgctggccagtacccatagtgcccgtccttgcggaggagaacttggagttcgcgctcagtgagatcgaagtcattcccgggggagaactgcccttcttgtgccggcctcccccacgcgcggagcccgactgtatctcggatgatcttttgattaacgtgatccaggatcgcagcacccccgacgggcccgctgacccccctctgctgcccatcccgcccccgccggcgctgcctccgcccgcgtcaaaggaaccgcccccgcaaccccctctggcaccgctggagcggcctgagatagagcccttttcaggagacccagtctacctggctgaattcctgatgcagctagagaccttcatagccgaccatgaggttcatttccccgggggcgccgagcgggtggcctttctgatctcctttttcactggcgaagccaaggactgggccatctcggtcacccaggaaggaagccccttgcatgccaacttcccgcgcttcctggatgaaatccgtaaggaattctgtggccccatccccccacgtgtggctaaaaaggccattcgcaagctcaagcagggccactgtaccctcggcagctatgcagatgcttttcagttcctggcccaattcttgtcttgggatgactgccgcctccaaaaccaattcctcaaaggcctgtcggaattcttccgcaaagagctcttatggtcaacagaaatggccgacctggatgagctgattctcgaatgtgtggagatagaaagaaaagtgcgcgttcccaagcctatcccgctccctggagttcgaaatatcatcttcccttttgctccgagtcccaatgaggaagaaagtgaagatgaagagtactacagtgaagatgaagaccaagaggcacgcaggcacaggcttcactccaaggaccagaggaagcgcatgagggcttttcagcaagagatgaaggagaaggaggaggaggagatgaagaaggaggaagaaatgaagaagaaggaagagaaggaggaggaggaggaagaggaaatgaaacagaaagaggaggaggaggagataaggaacaagaatgaggaggaaggagagagtaaggatgaagaagatgaagatgaggatgggggccagaaaccagaaggagagccacagcaggatccagggactgaggagacctatggtgaggtggaggaggagccactggatgaggcccaagatgatgacctagatgagctgatggagatggagccgacctttgttcacgcgtcatcccagacttctggccccacaagtggttaccacgccgaaaacttcctgggtgcatcacctcccataatacagcctagcagacggaggaaccagaatcgagtcccacttctggaaggccttccaggcaccaattcaccattctacagctccccccaactgattcgccgcacaggtcgtttaggacaacgccaagttcgaagacgcccccctgtgcttttccgcctcactccgagacaggggggccaccgagctgctcgtggccgaattcgagtttgagtgctggggccagatggccacccagaacacacccttcttttgcatcccccgcccctgctattgctgccatacctgccccatttgctgaccaggacttcagggagtttcagacctgcagaacctgaagaagacctgcagaattccagaccatcttgcaaccgtgaccagagagcgacgtgtgcccaaccagggccacctgggaaaggagggatcagcaatagctgccctcttggcatgtactctgctcagtccggccacgagctggagagcaagtttctgggcctgttcccataaatgaactggtcaccctcttgtatttcccctctggttgttcctaaccctcacctctcctgcgtttcttcaccctatgttctacagttttattctctgactgacccaccaggacttcacccaatgcctcactgatctgccccaatgagcaagaggacaggctaccctgaactcctaaagccactgaggccagttgctagatataatcgatggtgagcaggatggtatccagaaatgtccctagaatcctacactcatttcatgccacacctccagcagagggcctggaagaggacccgacatctagcccagtgagagtgtgcaaagccacatgtcaaatggacaacttgacggagatttgcccttgactgactgtgcaggctggttccacttacagcacttgagtttacctttgcacagattcctgtatcagggctcttggactgacttgccacacatctggagccctttcctctcaccacattgccctcctgggcacccccggtggacagcgcccaacattgcaggctccacaactttccttgatgttgcctaaagggtagccagttagggttccggagaggagaaggaggaagaagaggaggaggagaaagaagcagcaacgatcattctgccattgtaaagagtgactctttccttagggatggtggtcttctccccttgccaggccttggactgcagcccccagtcaaaggtctttgcaggacactttctatccttggagttgcagaggaggcctgattggccattccttctgggacagacagagagagggcccatggcctgctctgagctcccttcaatttcaaggaacccttagttctgagaggagagaggaaggctgcacctaccgtggcctcacagctgggacccctcatgggggccaacccctggcctgctgctgtgcttcagtgacacagtaaagcttaagagggtggctgcctcctaggaactcctgggacttctaggtacaaactcaggtgcccttataaagagacccactgcttgccttgagtccagaaagcactgcttctgcagtgaaaaacacacacttactatgtcagttttggccataaaatgccagccaaatccactgctggcctgaactgcccctggacactggactttctgcacagtgactggcagcagagcaagtgcagccagggtttgtggccaaagggaagaaagcatagtaaattcaacctctgttcctcatgggagtctgaccgataatctcaggcggaccttaggatcttgggcctggaggcaagagaaaaaagctggaggaagaggagtcgcagagaaacccagtcctctgactggtttctggtgaggtctctattcatcagtgggagctgattttatctgatttcctcaagagtgcattccagaaggggacctgctattcttcgaggggacctgctattcttcgaggcagtggaccctgtttgctgatggtcaacactctggccctgctgccccatgtccctgtggagaagtgtgaaggacgggtgccttaaacccacacttccagggacccttcagcacaggtcctgcctgttcccatggtgcttctcaccctgaaccctcagagctacagccagggatagagcagatgagcagtgagctggtttccaccctctggggcaggaggggcttgggcttccctttgaccctcttccttcctttcccagatcttcaatatttgttgtgatgtaacagccataagagctgtaagaggaactgtgggctttgggagctttcttgggttgaaagaggggtggggggaggggatgcatgcaggggtatgaaggcagcccaaggtctcccagaggctcgggaggaaacccttttggaatacatgtgttattgttgcattactgtgttgtgaagataagaagctgctctgtatgctaaagctttctctcctcaataaaaatataaagggtgtgtaaa

SEQ ID NO: 175530 - DNA, 4105 bp, Homo sapiens
  Payload ID: 14474
  Gene Symbol: RGAG4
  Gene Name: retrotransposon gag domain containing 4
  Uniprot ID: Q5HYW3
  ENST ID: ENST00000609883
  CDS Start-End: 289-1998
cgtgtcgcccgcatcctccgcctggcgcctccgggccccgtgcctccgcccgccctctccggccccggcgacgaggtaacgcgccctgggccgagccgccgggccctccgcccagagcgccgccctccgagctcgccccggtgggtgtggcccggcctggcccgtgccccgctgccgcacttcggtccctcccgagccccgccgccgcatttcggcctcctccggccgcccgtagttccagttcccctttccccaccacggagccccagggcccctgggcttgtcgagatgtctgaggcgtcaggaaatctcaacagcctccgcatggcgaatgtggccctgcgcgaagaattaaatgcccttcgcggggagaatgccaatttgggcctccagctcgggagagccctggccgaggttaattccttgcggggcaatgtctccagctacatccgctggccagtacccatagtgcccgtccttgcggaggagaacttggagttcgcgctcagtgagatcgaagtcattcccgggggagaactgcccttcttgtgccggcctcccccacgcgcggagcccgactgtatctcggatgatcttttgattaacgtgatccaggatcgcagcacccccgacgggcccgctgacccccctctgctgcccatcccgcccccgccggcgctgcctccgcccgcgtcaaaggaaccgcccccgcaaccccctctggcaccgctggagcggcctgagatagagcccttttcaggagacccagtctacctggctgaattcctgatgcagctagagaccttcatagccgaccatgaggttcatttccccgggggcgccgagcgggtggcctttctgatctcctttttcactggcgaagccaaggactgggccatctcggtcacccaggaaggaagccccttgcatgccaacttcccgcgcttcctggatgaaatccgtaaggaattctgtggccccatccccccacgtgtggctaaaaaggccattcgcaagctcaagcagggccactgtaccctcggcagctatgcagatgcttttcagttcctggcccaattcttgtcttgggatgactgccgcctccaaaaccaattcctcaaaggcctgtcggaattcttccgcaaagagctcttatggtcaacagaaatggccgacctggatgagctgattctcgaatgtgtggagatagaaagaaaagtgcgcgttcccaagcctatcccgctccctggagttcgaaatatcatcttcccttttgctccgagtcccaatgaggaagaaagtgaagatgaagagtactacagtgaagatgaagaccaagaggcacgcaggcacaggcttcactccaaggaccagaggaagcgcatgagggcttttcagcaagagatgaaggagaaggaggaggaggagatgaagaaggaggaagaaatgaagaagaaggaagagaaggaggaggaggaggaagaggaaatgaaacagaaagaggaggaggaggagataaggaacaagaatgaggaggaaggagagagtaaggatgaagaagatgaagatgaggatgggggccagaaaccagaaggagagccacagcaggatccagggactgaggagacctatggtgaggtggaggaggagccactggatgaggcccaagatgatgacctagatgagctgatggagatggagccgacctttgttcacgcgtcatcccagacttctggccccacaagtggttaccacgccgaaaacttcctgggtgcatcacctcccataatacagcctagcagacggaggaaccagaatcgagtcccacttctggaaggccttccaggcaccaattcaccattctacagctccccccaactgattcgccgcacaggtcgtttaggacaacgccaagttcgaagacgcccccctgtgcttttccgcctcactccgagacaggggggccaccgagctgctcgtggccgaattcgagtttgagtgctggggccagatggccacccagaacacacccttcttttgcatcccccgcccctgctattgctgccatacctgccccatttgctgaccaggacttcagggagtttcagacctgcagaacctgaagaagacctgcagaattccagaccatcttgcaaccgtgaccagagagcgacgtgtgcccaaccagggccacctgggaaaggagggatcagcaatagctgccctcttggcatgtactctgctcagtccggccacgagctggagagcaagtttctgggcctgttcccataaatgaactggtcaccctcttgtatttcccctctggttgttcctaaccctcacctctcctgcgtttcttcaccctatgttctacagttttattctctgactgacccaccaggacttcacccaatgcctcactgatctgccccaatgagcaagaggacaggctaccctgaactcctaaagccactgaggccagttgctagatataatcgatggtgagcaggatggtatccagaaatgtccctagaatcctacactcatttcatgccacacctccagcagagggcctggaagaggacccgacatctagcccagtgagagtgtgcaaagccacatgtcaaatggacaacttgacggagatttgcccttgactgactgtgcaggctggttccacttacagcacttgagtttacctttgcacagattcctgtatcagggctcttggactgacttgccacacatctggagccctttcctctcaccacattgccctcctgggcacccccggtggacagcgcccaacattgcaggctccacaactttccttgatgttgcctaaagggtagccagttagggttccggagaggagaaggaggaagaagaggaggaggagaaagaagcagcaacgatcattctgccattgtaaagagtgactctttccttagggatggtggtcttctccccttgccaggccttggactgcagcccccagtcaaaggtctttgcaggacactttctatccttggagttgcagaggaggcctgattggccattccttctgggacagacagagagagggcccatggcctgctctgagctcccttcaatttcaaggaacccttagttctgagaggagagaggaaggctgcacctaccgtggcctcacagctgggacccctcatgggggccaacccctggcctgctgctgtgcttcagtgacacagtaaagcttaagagggtggctgcctcctaggaactcctgggacttctaggtacaaactcaggtgcccttataaagagacccactgcttgccttgagtccagaaagcactgcttctgcagtgaaaaacacacacttactatgtcagttttggccataaaatgccagccaaatccactgctggcctgaactgcccctggacactggactttctgcacagtgactggcagcagagcaagtgcagccagggtttgtggccaaagggaagaaagcatagtaaattcaacctctgttcctcatgggagtctgaccgataatctcaggcggaccttaggatcttgggcctggaggcaagagaaaaaagctggaggaagaggagtcgcagagaaacccagtcctctgactggtttctggtgaggtctctattcatcagtgggaggtaagatgcccttttcattagcgcttttgtttctcagcctggggatcagtggatttggattcctataacctgttgctaccttttaaaaagatcccctctctccaaagagaaaagtaatacataatcattaaagaaagtttggaaaatagagaaaactatgaggacaaaaaccccccagccattcagagtcccaccacacagaggcaagcactattaacactttgctgctttcctttctagtgtgttcttgctatgtcttgtcaaagctgagatcaccctgccagttcttgatcagcaggatttaaaatggctgccacctgtgcagtcatgcatactgaataattcatttaagcattctcctaatttgttggacctttcaattgtctggttttccccatccccaccagggcaggagtaaacaactttgtaaagaaaatttt

SEQ ID NO: 175531 - DNA, 4193 bp, Homo sapiens
  Payload ID: 14475
  Gene Symbol: RTL1
  Gene Name: retrotransposon-like 1
  Uniprot ID: A6NKG5
  ENST ID: ENST00000534062
  CDS Start-End: 60-4136
gactggacgccatcacaaccttaccaatcttcagaatacactcctttccatccgacgaaatgatagaaccctctgaagactcatttgagacgatgatggagcataagaatccatcatcaaaacaaatggagtcctccgagggctcatccaacaccaccgaggcgacgtcgggcagtggagtgcggggagaggcagggccagccagcggcccagcccaggaaaagaaggagccccccagtggcccactccaggaaatggaagagctgcccactgatctactccaagacatggaggagccatccagtggcccacgtaaggaaatagaggatccacccaatgacctactccaagacctggaggagtcatgcaacggttcacaccaggcaaggggggatccactcagtggagcatctgataggatgaaagaagcatcagtcaacccatcgggagcccgagaagaacaagaggctcacactgacctgaaggaatcgggaagggaggagactcctcaagagcaaaaccagaccgagcactcaaccgcagaacttatggccatggtgaggtccatcatctcgctgtacttccgaatgcaagacctcaaagagcaacagagagtagcagaagagatcttgatcaaagggatcaatgcaggccaactgcccgccccaaagcacttctctggcgatcgcagagaattccacgagttcatcgtactctgccaactgaccttacagagctacccaagaatgttctataacgaccgtctgagagttggctatgtcatcaatcacctgtccggcttggcattagaatgggccaaagctctactgcaggaaaacagccccctgatcggagacttcccagccttcctggaggccatgtccgaagtgtttgagtaccgccaggcactgcgtgtggcagaagaggccatgttcaccatcaggcagggcggccgctctgccactgagtacatcgatgagttccagagcctggtacccatcttgggctggccagatgaagtcctgcaggcccacttgtgccaggggctcaacgaggagatcaggcactatctattccgggtccctcagccggattccctagacagtctgattgtgctcatcctgcaaatagaagagaagctggcagagagaagagctatgctcaggctgccccccgaggcccgcccccggaacctgacctggatcgactcacctgctccagagaggtggatggtcagcagctggttgcccagcgaagtccatccggacatcaatcgcgcccacctcttcctgctgctcatggtgagagtgaacccctaccacagcgtcgcggtccaggccctggtggattcgggagctgacggcaacttcatggatgagaagttcgcccaagagcactacgtcgagctctacgagaagccgtacccacagccggtccaatccgtggacggctcgctgattggcaacgagcctgtctggctctacacggagcccctggtgtgtatccaccagaaccaccaggagtccatcgaatttgacatcgtaccttcaccgaacttctctgtggtcctaggcatccgctggctccgagtccacgcccccgaagtcgactggatcaaaggccgctgcaccttccactctccctactgcctgaagaactgcttccgcccgcccccgccatgcattgccctagagaggcacggcatgagcctgctacccggactgccacacccatactcagacctggccgacgtgtttaacccgaaggaagcagatgatgagacttccgaccagccaagctcagacggatccgatgatctttctgaatcagagccctctgagcttcagcaggctggagacagtgatcacagcgagaccttttacgagtgtccctccaccgcgccttgggaacctgtgggtgccaggatgcaagaaagagccaggctacaggaggaatactgggacctgcaggacatgctgaccaacagacaggactacatacagatgattccggaactgtttgaccagttacacggagccgagtggttcacaaaactggagctgcgtgggaccattgtggaggaaagcgtgaacgggcaccgcaccgaagatgtgtggaaagcagcgtttggtttggagcttgaagagatgaagagctaccagccgtttgcgctctccccagaccctatcatacctcagaacgtgattcacttcatcctaaaggacatgctagggttctttgtgctttcttatggccaggaagtcctgatctactcaatgagtcaggaggagcacctccaccacgtccgccaagtcctggtccgcttccgccatcacaacgtctactgctccctggacaagagccagttccaccgccaaaccgtggaattcctgggcttcgtcgtcacccccaaaggggtgaaactgaacaagaacgtcatgaccatcataacagggtaccctacccctggctccaagctatctctgcgaaacttcatcgaattcgtcttcccctaccgccacttcgtggagcgcttcagcatcatcgcagagcccctggtgcggcagctgctgagctcctaccagttctactggggagtcgaggagcaagaggccttcgagtgcctgaagagggctttccgcaaggcgcctctcctccaccaccccaagccccagaacccattctacttggaaaccggcgtcaccggcacggccctgcacgcctccctgatccaaatcgacgaccaaaccggcaagagagcctgctgcgctttctactcccgcaacatctcccctatcgaggttgagtactctcaagcggagatgaagattcttccaatacgggctgccttcatggtgtggtgccgctacctggagaacaccgaggagcccatcatgatccttctcaacacagaggatctagcctctctgaataatgacaggctcaccgtacttctccccgggcattgggtcttcttcttctcccacttcaactttgacgtcatggagctgccagaacaagacggcggccgagctctgccacctgtgagaaacctccggtggaggagagccttccagaggaacactgccgccaggcaaaccctgctgctggcctcaaggggattccccagggatccatcgacggaatccggggaagaagagaatgaagaacaggatgagctcaatgaacagatcctacggcaagagctgctggccatgatacccatcgaccagatcctcaacagcttcctcgcccacttcagcatggcccagatcagggccgtcattctgcacttcttccgaggcctcctgtactggaagaacaccctagccctggcagccatcctcgtgctactgcgcgtgaggcaatgcctctcgctgcggccggcacccgccatgcgggtggctcggccccagccccagcgctccctacgactcatcctggattcgtccctcatcgcaggcagcagcatcacgacagccatcacccagctgctcacccagatgcccgctctcgtaggtgcaaacaccatcccagcccaggagctggctgagctgttcctgggccctggccgctggcagcgaaatgctctgcactcccaggcccaccgaggcctgcagttcacccctggcttctggctgacgctgtgtgagttcttcggtgtcagagtcaccccccaggagggccacctccctgccctgcgtcagaaccgctacctggagctgcacgtcgttggtgatgaggatgtcgtcttgcgagaagccctgcaagacgacctgcaacgttaccgtcagtgtggcctgcatgacggcctgcaagacacctcgcaggacaagcaggacaacgacgtgcaggaggccccacccagccacacagcagccacccacccaccccgcccacgccacctgatggatccccaggtcctggaattccttggtagccgcctgctccacatccacagtgcagatggccagctgcacctgctcagccgggagcaggcagccagggccctgagccagttcctgaccctgatctacaggcgggccctgcccatccccgcctgggagagccagcccagggagcaggcaaggctagaagagctgcctgatgaggacgaagatgctaacctcgactgaagacgcctccctgtctccagcaaagagtcccctctatttctcaccccaacacctccc

SEQ ID NO: 175532 - DNA, 4751 bp, Homo sapiens
  Payload ID: 14476
  Gene Symbol: REV1
  Gene Name: REV1, polymerase (DNA directed)
  Uniprot ID: Q9UBZ9
  ENST ID: ENST00000258428
  CDS Start-End: 230-3985
cggagggggaggggcggagagccaccgcggagcgcgcgcggggttggttgccgcgagcgtgggggagcgtggaccgcggcgctgctcagcggtggggctgccttcccccggccctcctccctggtccctggcgagggcactggcggcggcggggccggggtccgcaaggccggagaaggccgccgggcccgggcatggtggtctggggcaacgcggaagaagctccaccatgaggcgaggtggatggaggaagcgagctgaaaatgatggctgggaaacatggggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattcta

SEQ ID NO: 175533 - DNA, 4686 bp, Homo sapiens
  Payload ID: 14476
  Gene Symbol: REV1
  Gene Name: REV1, polymerase (DNA directed)
  Uniprot ID: Q9UBZ9
  ENST ID: ENST00000393445
  CDS Start-End: 168-3920
gggagcgtggaccgcggcgctgctcagcggtggggctgccttcccccggccctcctccctggtccctggcgagggcactggcggcggcggggccggggtccgcaaggccggagaaggccgccgggcccgggcatggtggtctggggcaacgcggaagaagctccaccatgaggcgaggtggatggaggaagcgagctgaaaatgatggctgggaaacatggggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattcta

SEQ ID NO: 175534 - DNA, 545 bp, Homo sapiens
  Payload ID: 14476
  Gene Symbol: REV1
  Gene Name: REV1, polymerase (DNA directed)
  ENST ID: ENST00000438366
  CDS Start-End: 1-292
ttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagagggtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagag

SEQ ID NO: 175535 - DNA, 577 bp, Homo sapiens
  Payload ID: 14476
  Gene Symbol: REV1
  Gene Name: REV1, polymerase (DNA directed)
  ENST ID: ENST00000450415
  CDS Start-End: 1-577
atgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagatataccagattcatcattgtgggagaatccagattctgcgcaagcaaatggaattgattctgttttgtcaagggctgaaattgcatcttgtagttatgaggccaggtccctcaaagttctggaaccctggctcctgcccagagtgatgtcctaccatgtacaatgctgttggcatctcaaccactgtggagccacttcaggagcatggaattggtcaattggga

SEQ ID NO: 175536 - DNA, 4727 bp, Homo sapiens
  Payload ID: 14476
  Gene Symbol: REV1
  Gene Name: REV1, polymerase (DNA directed)
  ENST ID: ENST00000413697
  CDS Start-End: 230-439
cggagggggaggggcggagagccaccgcggagcgcgcgcggggttggttgccgcgagcgtgggggagcgtggaccgcggcgctgctcagcggtggggctgccttcccccggccctcctccctggtccctggcgagggcactggcggcggcggggccggggtccgcaaggccggagaaggccgccgggcccgggcatggtggtctggggcaacgcggaagaagctccaccatgaggcgaggtggatggaggaagcgagctgaaaatgatggctgggaaacatggggtgggtatatggctgccaaggtccagaaattggaggaacagtttcgatcagatgctgctatgcagaaggatgggacttcatctacaatttttagtggagttgccatctatgttaatggatacacagattggttttcatgcttcacttcacactgaagaatatgtaagagctttcagaagtgaacttcaaagagccctcttaacttcatccagtagaagggcaatgtattttccagttccaaatttctggagtaattagttttcaaagagcagctagtagacggatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcaggttggcttggcctgtgttagatggcccaaggctgagatgtagtcgtctcatgatttgagaacataaacagactaaactatgcagatttaacccatttctctaactctgataagcttaaagcagctacccccaaatcttttaaattctgggacttgctttgaaaagtaacaaagcccattcctttgatagctgttagtgacatagttgtagaaatgcagttttcctttatccatgcagatctctgactttctccttcaaaaagactggtcctcatttgaagtttttcccccttcctagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgta

SEQ ID NO: 175537 - DNA, 10815 bp, Homo sapiens
  Payload ID: 14477
  Gene Symbol: REV3L
  Gene Name: REV3-like, polymerase (DNA directed), zeta, catalytic subunit
  Uniprot ID: O60673
  ENST ID: ENST00000358835
  CDS Start-End: 459-9851
gcacgagatctgcgcctcgcctccctcctcacgcgggcggattttcttaccttgtgaaaaaccgtctcagcggctgcccccgcctcctctgctggatgtgaaatggcggtcggcgagtggttgcgtccgtgacatcatcatcatggcaacaagagctgcagcctgggaccgaggagcccgtgtgattcccggcggtggcggcagtggcggcagcaccagcaccgacgaaagctcgagggcttctctcctgcggccccttgccgggtgctcctgaggaggcggcggcagcagcgcctacaccgccccgcccgccgctcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcaggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattg

SEQ ID NO: 175538 - DNA, 10701 bp, Homo sapiens
  Payload ID: 14477
  Gene Symbol: REV3L
  Gene Name: REV3-like, polymerase (DNA directed), zeta, catalytic subunit
  Uniprot ID: O60673
  ENST ID: ENST00000368802
  CDS Start-End: 324-9716
catcatcatggcaacaagagctgcagcctgggaccgaggagcccgtgtgattcccggcggtggcggcagtggcggcagcaccagcaccgacgaaagctcgagggcttctctcctgcggccccttgccgggtgctcctgaggaggcggcggcagcagcgcctacaccgccccgcccgccgctcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcaggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatata

SEQ ID NO: 175539 - DNA, 10461 bp, Homo sapiens
  Payload ID: 14477
  Gene Symbol: REV3L
  Gene Name: REV3-like, polymerase (DNA directed), zeta, catalytic subunit
  Uniprot ID: O60673
  ENST ID: ENST00000368805
  CDS Start-End: 84-9476
tggttgcgtccgtgacatcatcatcatggcaacaagagctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcaggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatata

SEQ ID NO: 175540 - DNA, 10644 bp, Homo sapiens
  Payload ID: 14477
  Gene Symbol: REV3L
  Gene Name: REV3-like, polymerase (DNA directed), zeta, catalytic subunit
  ENST ID: ENST00000434009
  CDS Start-End: 32-175
gtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaaattccgggtgtacctgtgcaggtttattacaaaggtatattgcataatgctgaggtttgaagtacgactgaacccgtcacctaggaagtgagcatagtactcaataggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatata

SEQ ID NO: 175541 - DNA, 10964 bp, Homo sapiens
  Payload ID: 14477
  Gene Symbol: REV3L
  Gene Name: REV3-like, polymerase (DNA directed), zeta, catalytic subunit
  ENST ID: ENST00000422377
  CDS Start-End: 459-602
gcacgagatctgcgcctcgcctccctcctcacgcgggcggattttcttaccttgtgaaaaaccgtctcagcggctgcccccgcctcctctgctggatgtgaaatggcggtcggcgagtggttgcgtccgtgacatcatcatcatggcaacaagagctgcagcctgggaccgaggagcccgtgtgattcccggcggtggcggcagtggcggcagcaccagcaccgacgaaagctcgagggcttctctcctgcggccccttgccgggtgctcctgaggaggcggcggcagcagcgcctacaccgccccgcccgccgctcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaagtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatata

SEQ ID NO: 175542 - DNA, 891 bp, Homo sapiens
  Payload ID: 14477
  Gene Symbol: REV3L
  Gene Name: REV3-like, polymerase (DNA directed), zeta, catalytic subunit
  ENST ID: ENST00000413831
  CDS Start-End: 1-555
agaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggt

SEQ ID NO: 175543 - DNA, 10943 bp, Homo sapiens
  Payload ID: 14477
  Gene Symbol: REV3L
  Gene Name: REV3-like, polymerase (DNA directed), zeta, catalytic subunit
  Uniprot ID: O60673
  ENST ID: ENST00000435970
  CDS Start-End: 821-9979
gcacgagatctgcgcctcgcctccctcctcacgcgggcggattttcttaccttgtgaaaaaccgtctcagcggctgcccccgcctcctctgctggatgtgaaatggcggtcggcgagtggttgcgtccgtgacatcatcatcatggcaacaagagctgcagcctgggaccgaggagcccgtgtgattcccggcggtggcggcagtggcggcagcaccagcaccgacgaaagctcgagggcttctctcctgcggccccttgccgggtgctcctgaggaggcggcggcagcagcgcctacaccgccccgcccgccgctcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaagtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattg

SEQ ID NO: 175544 - DNA, 969 bp, Homo sapiens
  Payload ID: 14477
  Gene Symbol: REV3L
  Gene Name: REV3-like, polymerase (DNA directed), zeta, catalytic subunit
  ENST ID: ENST00000619481
  CDS Start-End: 1-969
atgacttcctcattaccttactttatttttaatccccttagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggggatttattgcggcactattcacaatagcaaagacttggaaccaacccaaatgtccatcaatgatagactggattaagaaaatgtggcacatatacaccatggaatactatgcagccataaaaaaggatgagttcatgtcctttgcagggacatggatgaagctggaaaccatcattctcagcaaactatcacaaggacagaaaaccaaacaccgcctgttctcactcatagctcca

SEQ ID NO: 175545 - DNA, 4888 bp, Homo sapiens
  Payload ID: 14478
  Gene Symbol: RECK
  Gene Name: reversion-inducing-cysteine-rich protein with kazal motifs
  Uniprot ID: O95980
  ENST ID: ENST00000377966
  CDS Start-End: 567-3482
gatgaacccttgtcagggggccgtgtctgcgggaggccgaaggatcccgggtgacatgctttctttgggtgcgaggcagcgtctcggcagaaagaatattgcgagtattactgagggtacatgaaggagagaagcccctttggttcggccttggactaagcccttgttctcaggtgaacttgcagtgtgatcttgagtaaggtcagtctcctctctcacctcagtggcccgaaacctcaggaggtggcagaggttttctaatgactctcccagctctgacatcctctgacttcactctgggagaacgtgggctggtggactcctggcagaagccgacacacagttgggccataacaaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatagtttatattgctgtgacagagctgaagaccatgcttgccaaaatgcctgcaagagaatcctgatgtccaagaaaacggaaatggagattgttgatggtctcatcgagggttgtaagacccagcccttgcctcaagatcctctttggcaatgttttcttgaaagctcacaatctgttcaccctggagtcactgtacaccctcctccctctacaggcctcgatggggctaaattgcattgttgttctaaagcaaacacttcaacatgtagggaactctgcactaaactttacagcatgagctggggcaatacacagagttggcaagagtttgatcgcttttgtgaatataatccagtggaagtgtccatgttgacctgtttagcggatgtccgggaaccttgccagttgggctgtagaaaccttacttactgtactaattttaacaacaggccaacagaacttttcaggagttgtaatgcacagtcagatcaaggagccatgaatgacatgaagttgtgggagaaaggaagcataaagatgccatttatcaatatacctgttcttgatattaaaaagtgccagccagagatgtggaaagcaatagcttgttcactgcagattaaaccttgtcatagtaaatctcggggaagtattatttgcaaatcagattgtgtggagattcttaaaaaatgtggagaccagaacaaattccctgaagaccacacagctgaaagtatttgtgagcttctgtcacctacagatgatctgaagaattgtatacctttggatacatacctcaggccaagtactttaggtaacattgtagaagaagtgactcatccctgtaacccaaatccttgccctgccaatgagctctgtgaagtaaaccgaaaaggatgtccatctggagatccctgtcttccatacttttgtgttcaaggttgcaaactgggagaagcttctgatttcattgtccgtcaagggacactaatccaggtgccatcatctgcaggggaagttggttgttataaaatctgttcatgtggacaaagtggactcttagaaaactgtatggaaatgcactgtatagacctccagaagtcttgtattgttggaggaaaaagaaaaagtcatggaacatcctttagtattgactgcaatgtctgttcttgttttgctggcaatttggtgtgctctacccgcctttgcctcagtgagcacagttcagaagatgaccgtcgtaccttcacaggtctgccctgtaactgtgcagatcagtttgtccctgtatgtgggcagaatgggcgcacttaccccagtgcctgcattgctcgctgtgtgggcctccaagaccatcagtttgagtttggatcatgcatgtcaaaggatccatgtaatcctaatccctgccaaaaaaaccaaaggtgcatacccaaaccacaggtctgcctgacgacttttgataaatttggatgtagccagtatgagtgtgtaccaagacagctcgcgtgtgaccaggtccaagatcctgtttgtgacacagaccacatggagcacaacaatctctgcactttataccaaagaggaaaaagcctctcttacaaaggtccctgccagcccttttgcagagcaaccgagcccgtatgtgggcacaatggtgagacctacagcagtgtgtgtgctgcctactcggatcgcgtggcagtcgattactatggggactgccaggccgtcggagtcctctcagagcacagctccgtcgccgagtgtgcttctgtcaagtgtccttcgctcttggcagctggatgcaaacccatcatcccaccgggtgcttgttgcccattatgtgctgggatgttaagagttttatttgacaaagaaaaactggatactattgctaaggtaacaaataaaaagccaataacagttctggaaatacttcagaaaatccgcatgcacgtgtctgtcccacagtgtgatgtgtttggatacttcagcattgaatcagaaattgtgatcctgatcattcccgtcgatcactatccaaaagctctgcagattgaagcctgcaataaagaagcagagaagattgagtcccttatcaactctgacagcccgactttggcgtcccatgtccctctctctgccctcatcatttcccaggtacaggtctccagcagtgtgccatcggccggtgtcagggccaggccttcttgccactccctcctccttcccctcagcttgggccttgccttgcacttgctctggacatataactgactgcccacggaaagtgcagaatgctcctccacctcactctcctgccttgaaaaagacattcaggactgctggtttgtagttgaatattggccaaggaaaggcacatgtcacctctattcgccacacagtatttttttttttaatccgccaatattagtaggatttttgttttgtttttacaaatgttaaaatgtgttgttccaaatactaatgaaaacagaatgtctcttcctggtagaccactgccatatgatttacatttcctcaccataagggtcccccactctaaagcaaatttatcgctgggaaatgagatgaccactttttagaaagataattcactgtactatcaggttcacaaacttcatttcagagttctttttgaagtatttaaggttcccgttgcatttgttttgtttacagataattacctactctggctagaagctaggggtcccagtgaagagccactgccattaaagaatatgaaacatagataaaacatctttgaaattatgtaaattatgtaaattatcaggcaaatttgcattaaattacagaaatttaattcagaaccccaactactgtgttatgcaaaagcaagctgattaaatgacactcatataattatatgttgtaagcaacaggctcactggtcacggatttgtgtctgtgacttttgtgaaagggagaagtgacattgcatcaaagcatcttgcattatgcaatttttatattaaccagatatatattcatcggtattcatccaagttaaatgtagagtttttaaacatcaatctttaaaccaattgctgctacttatataattgccaaaaagtgaaataatgtgtagttcatgtaaataatacattatatttctattttattatgaagaaggtgaatagccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgtctaagaaattgaatactttgaatgtgtttcacagtttgaaataagctatttgatgtaatacttcttgtgtgtatgcacatgaacttagattttacatgaagtattttttcagtattatatgtaccctctgaaatacatagggatatgcgtattataccaaaatgttgctgaaaaatgggcacttaaagctttcagaatatgtcagtgctgatgtagcatgcttgttgcaattgccttttttctgtataaatgtctttaatgcaatatactggaaagcttttctattttaataaaaataatttttatatg

SEQ ID NO: 175546 - DNA, 4591 bp, Homo sapiens
  Payload ID: 14479
  Gene Symbol: REXO1
  Gene Name: REX1, RNA exonuclease 1 homolog
  Uniprot ID: Q8N1G1
  ENST ID: ENST00000170168
  CDS Start-End: 106-3771
gcggcggcggggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggctccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggattttaga

SEQ ID NO: 175547 - DNA, 1271 bp, Homo sapiens
  Payload ID: 14479
  Gene Symbol: REXO1
  Gene Name: REX1, RNA exonuclease 1 homolog
  ENST ID: ENST00000590936
  CDS Start-End: 1-485
tggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagggtcccaaccagtgaatgggcgtgatggatggataggatggtcccgaagggctcagagatgtgctgctgctgccacccccgcccccactgcaccccgaagctgccctcacctgccttctccacccccagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtc

SEQ ID NO: 175548 - DNA, 369 bp, Homo sapiens
  Payload ID: 14479
  Gene Symbol: REXO1
  Gene Name: REX1, RNA exonuclease 1 homolog
  ENST ID: ENST00000588743
  CDS Start-End: 1-369
tcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatggtgaggctgttctctgcccagcgtcgggttcaggattggg

SEQ ID NO: 175549 - DNA, 718 bp, Homo sapiens
  Payload ID: 14479
  Gene Symbol: REXO1
  Gene Name: REX1, RNA exonuclease 1 homolog
  ENST ID: ENST00000586343
  CDS Start-End: 1-193
taccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaagccgcagctgtgacccggagctgcctgggagagatgcaagtccccgaccccatggcgaccccaccgctggggctccccggcaccaggcaggcatggcctcagctgggcaccgcctgtcccccaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtac

SEQ ID NO: 175550 - DNA, 2360 bp, Homo sapiens
  Payload ID: 14480
  Gene Symbol: REXO4
  Gene Name: REX4 homolog, 3,-5, exonuclease
  ENST ID: ENST00000630460
  CDS Start-End: 201-1469
gcgcttccggggactggagcgtgcgtgctgaggtatgcgcaacgcgtgcggggtctcttccggagtcttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaaccaaccgagcccgtgacggactataggacagcggtcagtgggattcggcctgagaacctcaagcagggagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttggaa

SEQ ID NO: 175551 - DNA, 833 bp, Homo sapiens
  Payload ID: 14480
  Gene Symbol: REXO4
  Gene Name: REX4 homolog, 3,-5, exonuclease
  ENST ID: ENST00000626857
  CDS Start-End: 134-833
ttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgagagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggccc

SEQ ID NO: 175552 - DNA, 860 bp, Homo sapiens
  Payload ID: 14480
  Gene Symbol: REXO4
  Gene Name: REX4 homolog, 3,-5, exonuclease
  ENST ID: ENST00000627193
  CDS Start-End: 294-860
atactctgcacagtatctcagtgcagacattcctgtcttaacacacaggaccagtcaaattcccgtgggcagccccagggttctgtgggatttcttgaacaccaactcttcttccttctcccaagaaagaaaagcaaaataagtgaatggaagggatgtgtgctatagggaaactttggagtgttttctaattcatccaagaaagtcagcccttcagttctttacctatcacagaacagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaacca

SEQ ID NO: 175553 - DNA, 1899 bp, Homo sapiens
  Payload ID: 14480
  Gene Symbol: REXO4
  Gene Name: REX4 homolog, 3,-5, exonuclease
  ENST ID: ENST00000628678
  CDS Start-End: 253-1005
tgcgcggaaccagaggcagggatccggtttccagccggttgtggagagacgagcgcttccggggactggagcgtgcgtgctgaggtatgcgcaacgcgtgcggggtctcttccggagtcttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgagagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttggaatgg

SEQ ID NO: 175554 - DNA, 1899 bp, Homo sapiens; identical to SEQ ID NO: 175553
  Payload ID: 14481
  Gene Symbol: REXO4
  Gene Name: REX4 homolog, 3'-5' exonuclease
  Uniprot ID: Q9GZR2
  ENST ID: ENST00000371935
  CDS Start-End: 253-1005

SEQ ID NO: 175555 - DNA, 2360 bp, Homo sapiens; identical to SEQ ID NO: 175550
  Payload ID: 14481
  Gene Symbol: REXO4
  Gene Name: REX4 homolog, 3'-5' exonuclease
  Uniprot ID: Q9GZR2
  ENST ID: ENST00000371942
  CDS Start-End: 201-1469

SEQ ID NO: 175556 - DNA, 860 bp, Homo sapiens; identical to SEQ ID NO: 175552
  Payload ID: 14481
  Gene Symbol: REXO4
  Gene Name: REX4 homolog, 3'-5' exonuclease
  ENST ID: ENST00000445916
  CDS Start-End: 294-860

SEQ ID NO: 175557 - DNA, 833 bp, Homo sapiens; identical to SEQ ID NO: 175551
  Payload ID: 14481
  Gene Symbol: REXO4
  Gene Name: REX4 homolog, 3'-5' exonuclease
  ENST ID: ENST00000454825
  CDS Start-End: 134-833

SEQ ID NO: 175558 - DNA, 1828 bp, Homo sapiens
  Payload ID: 14482
  Gene Symbol: RFNG
  Gene Name: RFNG O-fucosylpeptide 3-beta-N-acetylglucosaminyltransferase
  Uniprot ID: Q9Y644
  ENST ID: ENST00000310496
  CDS Start-End: 9-1004
gcggccgcatgagccgcgcgcgtggggcgctgtgccgggcctgcctcgcgctggccgcggccctggccgcgctgctgttactgccgctgccgctgccccgcgcgcccgccccggcccggacccccgccccggccccgcgcgcgcccccgtcccggcccgctgcccccagcctgcggcctgacgacgtcttcatcgccgtcaagaccacccggaagaaccacgggccgcgcctgcggctgctgctgcgcacctggatctcccgggcccgccagcagacgtttatcttcaccgacggggacgaccctgagctcgagctccagggcggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgccaggagcctcctgcacctgctctccagcttctcacccagccaggacgtctacctggggcggcccagcctggaccaccccattgaggccaccgagagggtccagggtggcagaactgtgaccacggtcaagttctggtttgctactggtggggccgggttctgcctcagcagaggccttgccctcaagatgagcccatgggccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacataacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccacaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttacttca

SEQ ID NO: 175559 - DNA, 994 bp, Homo sapiens
  Payload ID: 14482
  Gene Symbol: RFNG
  Gene Name: RFNG O-fucosylpeptide 3-beta-N-acetylglucosaminyltransferase
  ENST ID: ENST00000429557
  CDS Start-End: 204-821
cccggcccaggcccccggaggctccgcgcggggcgggtcggtctccggcctgggcagcgccccagaagcctcatagattgtttctcccccagacgtttatcttcaccgacggggacgaccctgagctcgagctccagggcggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgccaggagcctcctgcacctgctctccagcttctcacccagccaggacgtctacctggggcggcccagcctggaccaccccattgaggccaccgagagggtccagggtggcagaactgtgaccacggtcaagttctggtttgctactggtggggccgggttctgcctcagcagaggccttgccctcaagatgagcccatgggccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacataacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccacaccagtgagatgcaggcacctggcagaccctctggctagcctgcagccccccctctcccagcccctggtgggct

SEQ ID NO: 175560 - DNA, 649 bp, Homo sapiens
  Payload ID: 14482
  Gene Symbol: RFNG
  Gene Name: RFNG O-fucosylpeptide 3-beta-N-acetylglucosaminyltransferase
  ENST ID: ENST00000578356
  CDS Start-End: 468-649
agaccacccggaagaaccacgggccgcgcctgcggctgctgctgcgcacctggatctcccgggcccgccagcagacgtttatcttcaccgacggggacgaccctgagctcgagctccagggcggtgagtgtcccccactccccggcgcccgcgggatctgccccccgagcctttctcgctccgaagccacggccccttcgctgctgtgggtgcctttctctgcccaggctcccgaggcccggggaggccccgacgctgcccaggtcacgcggcctgcggagggcccaccctgccagccaagctctgctccccaccagcctctcacactagccgcttcccggggcgtggggctagtgccacgtcccctgaagaagcgccagcagggaatccgcccttccaggccaggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgccaggagcctcctgcacctgctctccagcttctcacccagccaggacgtctacctggggcggcccagcctggaccaccccattgaggccaccgagagggtcca

SEQ ID NO: 175561 - DNA, 1117 bp, Homo sapiens
  Payload ID: 14483
  Gene Symbol: RFPL3S
  Gene Name: RFPL3 antisense
  ENST ID: ENST00000382084
  CDS Start-End: 60-269
caaagttcatagcaggttgaacatgcttgctgtcattttcacagattctggtctttcttatggggaacctgagttcctgcattaaagttcccccagaagatcaatggaaggtggattccaaagagtgggcaagtgaggaccccttctctgttaccaaggtgaccccaaggaacacagtaaatgtggcggcttatttggcctccccaggacggactggagcatcagtagtgcctgagttcatcaaaggacagatgctcaagacaccttgatcaccattaggtggaattgaaggagccaaaaatgggcgcagtggctcctcagcagagacgctcctgaatgtatagacatgggaaccactttcagcatcaaaaaaggaaacgttctgcatgcccatatccagaaaaatccccactcgctgtaacttgcggtctactaagaggaaagtcagcggcaccgtgctggcagagaggcggcttccatccctcaaactcacagtccagaatccaagctctgtggtcagctggatcttccctttgcagtgaacagattctctgcagactcccaggtcccattctgtgcttgttcccacgtccacctcccagtagtggcggccacaggtaaagcgaggggagcccaggatgcaaacggacacgtcaaatctctcggcaaggtcttgccgattctgtgtgatgagcccacttcggacgctcctgaggtcgtcagaaatgaggaggaagttgttggctgtgtcggcatccaaggtcatatccactgtgaaaaggaaaacaagttgctcagcaagtggacagaagccaaccccatgcctctcttctacttcaaaggcccaaatatctcctgactttagtttctttaattctgtttcttcctccaaaatcaaaacttttcatgaggaaacttccctatttcaaattttcataggtatgctttgtggcaatacgtgactcttattcacagtagcaattcttattttactttacgtcacgtgtttgcttcactgaacttttcttcatttagagtggagggtctctgaaggcagacaccatgcccccctttctaccaccttgatgtgtgaacaaataaatgataattaagacaa

SEQ ID NO: 175562 - DNA, 455 bp, Homo sapiens
  Payload ID: 14483
  Gene Symbol: RFPL3S
  Gene Name: RFPL3 antisense
  ENST ID: ENST00000382086
  CDS Start-End: 74-304
tgtgctgagtttttcaaagttcatagcaggttgaacatgcttgctgtcattttcacagattctggtctttcttatggggaacctgagttcctgcattaaagttcccccagaagatcaatggaaggtggattccaaagagtgggcaagtgaggaccccttctctgttaccaaggtgaccccaaggaacacagtaaatgaaattttaagaagatatagcctctacaccaagaggcacatgacacaacctggactctgggcaaaccaccgggtgcactcacatgaaggtaccgtggaaatttattaagttgatttaagaataacaattgtggattgtattcagtgtcccatatgttagaagaagctatagaggaggttaagccatatgtttaaatgtgccaaaatttttatttgcctaatcaagaggtattgctgaaatcacaaaattaaatatacat

SEQ ID NO: 175563 - DNA, 1295 bp, Homo sapiens
  Payload ID: 14483
  Gene Symbol: RFPL3S
  Gene Name: RFPL3 antisense
  ENST ID: ENST00000400234
  CDS Start-End: 151-447
tgagacgttgatgatgctcctatcaccatggttatgtgattgggtatatcttgccctcggtcctaactgccactgtctgtgctgagtttttcaaagttcatagcaggttgaacatgcttgctgtcattttcacagattctggtctttcttatggggaacctgagttcctgcattaaagttcccccagaagatcaatggaaggtggattccaaagagtgggcaagtgaggaccccttctctgttaccaaggtgaccccaaggaacacagtaaatgaaattttaagaagatatagcctctacaccaagaggcacatgacacaacctggactctgggcaaaccaccgggtgcactcacatgaagtggcggcttatttggcctccccaggacggactggagcatcagtagtgcctgagttcatcaaaggacagatgctcaagacaccttgatcaccattaggtggaattgaaggagccaaaaatgggcgcagtggctcctcagcagagacgctcctgaatgtatagacatgggaaccactttcagcatcaaaaaaggaaacgttctgcatgcccatatccagaaaaatccccactcgctgtaacttgcggtctactaagaggaaagtcagcggcaccgtgctggcagagaggcggcttccatccctcaaactcacagtccagaatccaagctctgtggtcagctggatcttccctttgcagtgaacagattctctgcagactcccaggtcccattctgtgcttgttcccacgtccacctcccagtagtggcggccacaggtaaagcgaggggagcccaggatgcaaacggacacgtcaaatctctcggcaaggtcttgccgattctgtgtgatgagcccacttcggacgctcctgaggtcgtcagaaatgaggaggaagttgttggctgtgtcggcatccaaggtcatatccactgtgaaaaggaaaacaagttgctcagcaagtggacagaagccaaccccatgcctctcttctacttcaaaggcccaaatatctcctgactttagtttctttaattctgtttcttcctccaaaatcaaaacttttcatgaggaaacttccctatttcaaattttcataggtatgctttgtggcaatacgtgactcttattcacagtagcaattcttattttactttacgtcacgtgtttgcttcactgaacttttcttcatttagagtggagggtctctgaaggcagacaccatgcccccctttctaccaccttgatgtgtgaacaaataaatgataattaagacaa

SEQ ID NO: 175564 - DNA, 489 bp, Homo sapiens
  Payload ID: 14483
  Gene Symbol: RFPL3S
  Gene Name: RFPL3 antisense
  ENST ID: ENST00000577714
  CDS Start-End: 281-489
ccgcaacctccacctcccgggttcaagcgattctcctgcctcagcctcctgagtagctgggattacaggtacaaccacagggctccccatgaggtgatgtcatcgaattttcctggctgaagagtcgtcctttgtgtacacacatgggagtttattttttcatctgcatatggacgcattcctgagacttcagaaacattctatggagaattgagaagagagtattttttgagccagaaagtgctttcctgtgaagtttgtatatattctggtctttcttatggggaacctgagttcctgcattaaagttcccccagaagatcaatggaaggtggattccaaagagtgggcaagtgaggaccccttctctgttaccaaggtgaccccaaggaacacagtaaatgaaattttaagaagatatagcctctacaccaagaggcacatgacacaacctggactctgggcaaaccaccgggtgcactcacatga

SEQ ID NO: 175565 - DNA, 433 bp, Homo sapiens
  Payload ID: 14483
  Gene Symbol: RFPL3S
  Gene Name: RFPL3 antisense
  Uniprot ID: P0C7P2
  ENST ID: ENST00000621921
  CDS Start-End: 53-376
cacgtccacctcccagtagtggcggccacaggtaaagcgaggggagcccaggatgcaaacggacacgtcaaatctctcggcaaggtcttgccgattctgtgtgatgagcccacttcggacgctcctgaggtcgtcagaaatgaggaggaagttgttggctgtgtcggcatccaaggtcatatccactgtgaaaaggaaaacaagttgctcagcaagtggacagaagccaaccccatgcctctcttctacttcaaaggcccaaatatctcctgactttagtttctttaattctgtttcttcctccaaaatcaaaacttttcatgaggaaacttccctatttcaaattttcataggtatgctttgtggcaatacgtgactcttattcacagtagcaattcttattttactttacgtcacgtgtttgcttcactga

SEQ ID NO: 175566 - DNA, 5108 bp, Homo sapiens
  Payload ID: 14484
  Gene Symbol: RFT1
  Gene Name: RFT1 homolog
  Uniprot ID: Q96AA3
  ENST ID: ENST00000296292
  CDS Start-End: 63-1688
cttatcgcgactaaacggagtggcggcggcatttcctggtgtctgagcctggcgcggaggctatgggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcacccagcgagactggagccagaccctcaacctgctgtggctaacagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcattttatagtaatcagcattttctcttttactaatatactcattccttttgcgtatgattggcctttggagctacatgctccaacaaactatatcttaattgttaactgttaataattatctggcccagaaaaagagatgcagtgattttacccttcacaggaatattgaacttcttctgtaaaagagagagagaaacctctctctctcatgcaccacatggaaacagagtgtggccctgaagttgtggctttctttgtgtcaaaactgtggtctgagtttttagagaaggaaaaatgctactcagtgagaaatccaagaaatgaaaccaggaaggttttcagatcacatttcccagagtgagttcgggagaatcttgcctgtcgtgatcacactgttccccgccgccccaggtcagcacatacttgacccagagtgggctctcaggatttgttgattgaagggtgggtgaaagctggctggagactcctggcctggccacctgcaagaggcggactttgaagaaaactgtgatccagttgagccactttgtccctgaggggaatgctgctttgcagctttctgtaacttctcacatgggaattgcactggtgacagataaggtttaacagatgtacttttttatcctcagaataagacaaggcaaactctatatggctagtattactgagtcaggtccctcccgttgacccattaattccagcattgatcaatacaaccaaattccagccccaggacaagagtggcaggcatgggggcctggtactccaggctacagtgtgagcccaggtgttctgcaccttgcagcctgcacactgcaggtgaaatcatgagcagtgttctggagtgtgaagtgtttttatttttttgttaatgtattaattccttttagatattaacccccctcagaactatatgcacaaactataacttggatgttaataatcctgtcactcagtgccccaaaccttctgtgtctacacctagagagagggccagtaagggcaactcctatcatgcattaaaatgcatgtatttaaatctgcttgcccagagccagtacccaggggctaaggattaagacctgtcagtacaccaagactggggcccagtcacctggcaggtttttatctactcagagggagaatgctttgcactaagtgggagaaaagcagctaaatgcaaggtgtcctgagcaattagaggacctccaaagcatggcctcagtcatgccttcatcgggcaaggtcaggccagctcagaaaaatggatggtcccatagggtcaagtggagcacacacggaaggcagtcctccttccctcccatgtcctttctctgtccctggcatccacagaaagggaccttcagtcctcatgagctgcttctctgcagctgctgatcaccctcccggaaccctgcacctatcccgtgcccacctgaccccagactcaagcatgatcctcattctacctgcctcggaatcacctggattgcaagtcagaacatggcttcccaggacccactccaggccttcagggtctgtgtctcccaggaggagggctctgagattggcttttctggcaagcccacgtggctttgatgccaccaaggttggcatgccccattgtcttccttcgtgacaggcccaggaccatcatgctcatgctcacagtgcctgttctctgctccaggaacagagctgctgctctacaagcagccttgtgactccggggtctctgggagcaggactccccaggcttgtgctctctcagcttgagagaggctctatgtctgaaggcagtgctcactctctcatccctcccctgctgttcgcccagtgctgctgtcagggccagctcctcttgaaagacagccagccgcaaaggcagcccagggcttcttccggtgtcctgcttccctgtatctagggagagttgtacatgtggctgcgtgttttcccaggactagccctgccgcctgggctgtcagcactttggcagcaggtcctctgtggttctctgcctctggtgcctccctaaagctcagctggacctgaccaggcctctggcatttcccctgctggaccccctagagccacagctgtgcctcagggagcttgcatacatgtgggccagcctgcctcactttacccaagtggatttggggagcagaaatcatacttttggctttcaataccacttatagtgaggctacttctccatggaaacaagtctctgaggcacaacctttatgaaaggaaggagcattcgttggtgagaagaacagtatcgctgacttcctgtgctcctctggccacaggtaactgttggtcacttcagatttggcttggggtctctcagtgaggagctgctgctgtgctgtttaatgcttacctgatggcaacttctggctctggaaccgctactctgccctgttcccagccacttcccaacctgattcaagcagggcccctccttcctcctgtctttatttatttatttattgagacagagtctcactctgtcgcccaggctggagtgcagtagcgcgatctcggctcactgcgagctctgcctcctgggttcaagcgattctcttgcctcagcctcctgagtagctggggctacaggcgcctgccaccacacccggctaatttttgtatttttagtagagacagggtttcaccatattggccaggctggtcttgaactcctgaccttgtgatccgcccgcctcagcctcccaaagtgctgggattacaggcgtgagccaccgctcctggcctattcttttcttttcagagacaaggtctcactctctcctctcgcccaggctggagtgcagtggtgtcatcatagctcattgcagcctcaaactcctgggctcaagcaatcctcccacctcagcctcctgagtagctgggatcacaggtgtgtgctacctcacccagctaatttctaatttttttttgtagagactggatctcactgttgccttgaactcctgggctcaagtgatcctcctgcctcagcctcccaaagtgctgggattccagaccagccattttttttccttaatcatgcattcctgttgctagtttcacatcagtcccctggtttaataagaaataaaatattttcttcacacttttgaaaa

SEQ ID NO: 175567 - DNA, 1800 bp, Homo sapiens
  Payload ID: 14484
  Gene Symbol: RFT1
  Gene Name: RFT1 homolog
  ENST ID: ENST00000394738
  CDS Start-End: 54-1562
actaaacggagtggcggcggcatttcctggtgtctgagcctggcgcggaggctatgggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagtttt

SEQ ID NO: 175568 - DNA, 886 bp, Homo sapiens
  Payload ID: 14484
  Gene Symbol: RFT1
  Gene Name: RFT1 homolog
  ENST ID: ENST00000467048
  CDS Start-End: 12-886
gcgcggaggctatgggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcacccagcgagactggagccagaccctcaacctgctgtggctaacagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccaggcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgct

SEQ ID NO: 175569 - DNA, 1686 bp, Homo sapiens
  Payload ID: 14485
  Gene Symbol: RFX8
  Gene Name: RFX family member 8, lacking RFX DNA binding domain
  Uniprot ID: Q6ZV50
  ENST ID: ENST00000428343
  CDS Start-End: 121-1542
ataactccaacgctcaagcaagtcaaggacacccacggactcaacaccgcgaccagattggaaaaggtgttggtcgacaacttctgcatttgcgaagagtgcagcgtccctcgctgtctcatgtatgagatttacgtggagacctgtgggcaaaacactgagaaccaagtcaacccggccacctttgggaagtgtgaagatcattcaccgatgaagacagacccagttggatcccctttgtctgaattcaggagatgtccatttctggagcaagaacaggcaaagaaatactcctgtaatatgatggccttccttgctgacgaatactgcaactattgtcgagacattttacgaaatgtggaggacttgcttacttccttctggaagtctctgcagcaagacacagtcatgctgatgtcattgcctgacgtgtgccagctctttaaatgctacgacgtccagctgtacaagggaattgaggatgttctccttcatgacttcttggaagatgtttctattcagtacctgaaatctgtgcagttatttagtaagaaatttaagctgtggctccttaatgctttggaaggtgttccagccctcttgcagatctccaaactcaaagaagttactctatttgtcaaaagactaagaagaaagacgtacctttccaacatggctaagactatgcgaatggtattgaaaagtaagaggcgtgtcagcgttttgaagtcagatctacaggccatcatcaatcaaggcactttggctacttctaagaaagccctggcaagtgaccggagtggcgcagatgaactggagaacaacccagagatgaaatgtttaagaaacttaatttctttgctgggaacatcaacagatctcagggtattcctcagctgtctgtcttcacatctccaagcatttgtgttccagacaagcagaagcaaagaagagtttaccaaattggccgccagcttccagctgagatggaatcttcttctcactgctgtaagcaaagccatgaccctctgccacagagatagttttggctcctggcatctgtttcacttgttgcttttggaatatatgattcatatacttcagtcatgcctagaggaggaagaggaggaggaggacatggggactgtcaaggaaatgctaccagatgacccgactctcggccagccagaccaggcacttttccattctctgaattcctcactgtcgcaggcgtgtgccagccccagcatggagccactgggggtgatgcccacacacatgggccagggccgatatcccgtgggtgtgagcaacatggtcctcaggatcctgggcttcctggtggacactgccatgggcaataagctcatccaggtgctgttggaagatgaaaccactgaaagcgcagttaaactcagccttcctatgggacaagaagccctcataaccctaaaagatggacaacaatttgtgattcagatatcagatgtaccccaaagctctgaagatatttatttcagagaaaacaatgctaatgtgtgagattatttatttgaatagagaataagaaaactgatagacttgcattcttaaaaatattaaatactaaagtttttctattgacgaaagatgatgttatgtatataatagatgtagcattgtctattttatgtttatatgtatttc

SEQ ID NO: 175570 - DNA, 1907 bp, Homo sapiens
  Payload ID: 14485
  Gene Symbol: RFX8
  Gene Name: RFX family member 8, lacking RFX DNA binding domain
  ENST ID: ENST00000481179
  CDS Start-End: 121-582
ataactccaacgctcaagcaagtcaaggacacccacggactcaacaccgcgaccagattggaaaaggtgttggtcgacaacttctgcatttgcgaagagtgcagcgtccctcgctgtctcatgtatgagatttacgtggagacctgtgggcaaaacactgagaaccaagtcaacccggccacctttgggaagcttgtgagattggtttttccggaccttggcacccggaggctgggcactagaggaagtgccaggtatcattatgatggaatctgtatcaagaaaagctctttcttctatgcccagtattgctacctgataggtgaaaaaaggtatcacagtggagatgccattgcctttgaaaaatctactaattataacagcattatccaacaagaagcaacatgtgaagatcattcaccgatgaagacagacccagttggatcccctttgtctgaattcaggagatgtccatttctggagcaagaacaggcaaagaaatactcctgtaatatgatggccttccttgctgacgaatactgcaactattgtcgagacattttacgaaatgtgaggaactgagaacttgagagggtggaggacttgcttacttccttctggaagtctctgcagcaagacacagtcatgctgatgtcattgcctgacgtgtgccagctctttaaatgctacgacgtccagctgtacaagggaattgaggatgttctccttcatgacttcttggaagatgtttctattcagtacctgaaatctgtgcagttatttagtaagaaatttaagctgtggctccttaatgctttggaaggtgttccagccctcttgcagatctccaaactcaaagactatgcgaatggtattgaaaagtaagaggcgtgtcagcgttttgaagtcagatctacaggccatcatcaatcaaggcactttggctacttctaagaaagccctggcaagtgaccggagtggcgcagatgaactggagaacaacccagagatgaaatgtttaagaaacttaatttctttgctgggaacatcaacagatctcagggtattcctcagctgtctgtcttcacatctccaagcatttgtgttccagacaagcagaagcaaagaagagtttaccaaattggccgccagcttccagctgagatggaatcttcttctcactgctgtaagcaaagccatgaccctctgccacagagatagttttggctcctggcatctgtttcacttgttgcttttggaatatatgattcatatacttcagtcatgcctagaggaggaagaggaggaggaggacatggggactgtcaaggaaatgctaccagatgacccgactctcggccagccagaccaggcacttttccattctctgaattcctcactgtcgcaggcgtgtgccagccccagcatggagccactgggggtgatgcccacacacatgggccagggccgatatcccgtgggtgtgagcaacatggtcctcaggatcctgggcttcctggtggacactgccatgggcaataagctcatccaggtgctgttggaagatgaaaccactgaaagcgcagttaaactcagccttcctatgggacaagaagccctcataaccctaaaagatggacaacaatttgtgattcagatatcagatgtaccccaaagctctgaagatatttatttcagagaaaacaatgctaatgtgtgagattatttatttgaatagagaataagaaaactgatagacttgcattcttaaaaatattaaatactaaagtttttctattgacgaaagatgatgttatgtatataatagatgtagcattgtctattttatgtttatatgtatttcaaggaggtggtttcgataaaatatgtaaactgatttggagaat

SEQ ID NO: 175571 - DNA, 530 bp, Homo sapiens
  Payload ID: 14485
  Gene Symbol: RFX8
  Gene Name: RFX family member 8, lacking RFX DNA binding domain
  ENST ID: ENST00000484091
  CDS Start-End: 119-361
aactccaacgctcaagcaagtcaaggacacccacggactcaacaccgcgaccagattggaaaaggtgttggtcgacaacttctgcatttgcgaagagtgcagcgtccctcgctgtctcatgtatgagatttacgtggagacctgtgggcaaaacactgagaaccaagtcaacccggccacctttgggaagcttgtgagattggtttttccggaccttggcacccggaggctgggcactagaggaagtgccaggtatcattatgatggaatctgtatcaagaaaagctctttcttctatgcccagtattgctacctgataggtgaaaaaaggtatcacagtgtgaagatcattcaccgatgaagacagacccagttggatcccctttgtctgaattcaggagatgtccatttctggagcaagaacaggcaaagaaatactcctgtaatatgatggccttccttgctgacgaatactgcaactattgtcgagacattttacgaaatgtgaggaactgagaacttgagagggt

SEQ ID NO: 175572 - DNA, 4687 bp, Homo sapiens
  Payload ID: 14486
  Gene Symbol: RLTPR
  Gene Name: RGD motif, leucine rich repeats, tropomodulin domain and proline-rich containing
  Uniprot ID: Q6F5E8
  ENST ID: ENST00000334583
  CDS Start-End: 329-4636
ggcccgccacacccgcgaccctcccggccacgccactgcccaccccgacgtctaccctggcggagaagctcctgggcgacggggcgggcgggcaggtgggactcggcccccctcccacaaccccgctcccgggcaagctctcgagccgcgaggccggggcggggaggggccgggccgggggcggcctggcaggaagcggcgcgcaccttccgccgccggaggagcaggtggctgccgtgcgggtctgggccccaggcttcctgtgtgcgcgctcgtcctctgctgtttcccgccggagctcgttgggcctccccggcccgcccggcccatggcccagacccccgacggcatctcctgtgagctccgaggcgagatcaccaggttcctgtggcccaaagaggtggagctgctgctgaaaacctggctacccggggagggtgctgtgcaaaaccatgtcctggcactgctacgatggagagcctacctgctgcacaccacctgcctcccgctgagggtggactgcacgttcagctacctggaggtccaggccatggcgctgcaggagacaccccctcaggtcacctttgagctggagtccctgcgtgagctggtcctggagtttcctggtgtggccgccctggaacagctggcccagcacgtggctgcagccatcaagaaggtcttccctcgctcgacccttgggaagctattccggaggcccacaccagcctccatgctggctcggctggagagaagcagcccctcggagtccactgacccctgcagcccctgtggtggcttcttggagacatacgaggctctgtgtgactacaatggcttccctttccgagaggagattcagtgggacgtggacaccatttaccatcgccagggctgccgccatttcagcctgggagacttcagccacctcggcagtcgggacctggccttgagtgtggctgccctgtcctacaacctgtggttccggtgcctctcctgtgtggacatgaagctgagccttgaggtctcagaacagattctgcacatgatgagtcagtcatcacacctggaggagctggtgctggagacctgcagcctgaggggagactttgtccgacgactggcccaggcgctggcgggacactcaagctctgggctgcgggagctcagcctcgcggggaacctgctggatgaccgaggcatgactgcactcagcagacacctcgagcgttgtccaggagccctgaggagactcagcctggcccagacagggttgacaccgcgaggaatgagggctctgggccgggcactggccaccaatgccgccttcgactccaccctgacccacctggacctttctgggaatcctggggcgctgggggcctccgaggacagtgggggcctctatagcttcctgagccgtcctaacgtactgtcgttcctgaatctcgcaggcaccgacactgccctggacactgtgagggggtgctccgtggggggatggatgaccggcagggcggactggagggcgggacggggagggctcggtccccccgcgggtgtagccaacagcctccccccgcagctcttcgcagcggtatcccgaggctgctgcaccagccttacccacctcgacgcttcgaggaacgtcttctcccgcacgaagtcccgcgccgcgccggccgcgctgcagctcttcctcagccgcgcgcggacgctgcggcacctgggcctggcgggctgcaagctgccgcccgacgcgctcagagcccttttggatggcctcgcgctcaacacgcacctccgcgacctgcacctggacctcagcgcttgcgagctgcgctcggccggcgcccaggtgatacaagacttagtgtgcgacgcaggcgctgtgagctccctggatctggcggataacggcttcggctcagacatggtgactctggtgctggccatcgggagaagccggtccctgagacatgtggcgcttggaaggaacttcaacgtccggtgcaaggagaccctggacgacgtcctgcaccggattgtccagctcatgcaggacgacgattgtcctcttcagtctctgtcggtggctgagtctcggctgaagctgggtgccagcgtcctactccgggccctagccaccaatcctaacctgaccgcgctggatatcagcggcaacgccatgggggacgcgggcgccaagttgctggccaaggcgctgcgggtcaactcgaggctccggtctgtggtctgggaccggaaccacacatctgctttgggtctgctggacgtggcgcaggcgctggagcagaaccacagcctgaaggccatgcctctgccactgaacgacgtggcccaggcgcagcgcagccgcccggaactgacagcacgtgcagtccatcagatccaagcctgtctcttgaggaacaaccgcgcagaccctgcctcttctgaccacacgacccgccttcagccacttggtctggtctcagacccctcagagcaggaagtgaatgaattgtgtcagtcggtgcaggagcatgtggagctgctgggctgtggggctgggccccagggtgaagccgctgtgcgccaggccgaggatgccatccaaaatgccaacttctctctcagcattctccccattctatatgaagctggaagctccccaagccatcactggcagcttgggcagaagctggagggccttctgagacaggtgggcgaggtctgccgccaggacatccaggacttcactcaggccacactggacacagcaaggagcctctgcccacagatgctgcagggatccagctggagggagcagctagagggggtcctggcaggctcgaggggcctcccggagctgctcccagagcagctgctgcaagatgccttcactaggctcagggacatgcggctatcaatcacggggaccttggcagagagcattgtggctcaggctttggcaggcctgagtgcagcccgggatcagctggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggatgacagtcctccacagaaatggcctgagctcagccacggtcttcacctggtccccttcattcacagtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtacccccagccttgccgcaggaagggaatgggctcagtgcccgcgtggacgagggcgtggaggaattcttctccaaaaggctgatccagcaggatcgcctctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaagatggccagctgaggccgaggcctctctcggcagggcggcgagcagtgtctgtgcatgaggaccagctccaggcccctgctgaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctgatcctctcctctcctgccgcatgagattattttattaaaaaactcaaaggaa

SEQ ID NO: 175573 - DNA, 4119 bp, Homo sapiens
  Payload ID: 14486
  Gene Symbol: RLTPR
  Gene Name: RGD motif, leucine rich repeats, tropomodulin domain and proline-rich containing
  Uniprot ID: Q6F5E8
  ENST ID: ENST00000545661
  CDS Start-End: 1-4119
atggcccagacccccgacggcatctcctgtgagctccgaggcgagatcaccaggttcctgtggcccaaagaggtggagctgctgctgaaaacctggctacccggggagggtgctgtgcaaaaccatgtcctggcactgctacgatggagagcctacctgctgcacaccacctgcctcccgctgagggtggactgcacgttcagctacctggaggtccaggccatggcgctgcaggagacaccccctcaggtcacctttgagctggagtccctgcgtgagctggtcctggagtttcctggtgtggccgccctggaacagctggcccagcacgtggctgcagccatcaagaaggtcttccctcgctcgacccttgggaagctattccggaggcccacaccagcctccatgctggctcggctggagagaagcagcccctcggagtccactgacccctgcagcccctgtggtggcttcttggagacatacgaggctctgtgtgactacaatggcttccctttccgagaggagattcagtgggacgtggacaccatttaccatcgccagggctgccgccatttcagcctgggagacttcagccacctcggcagtcgggacctggccttgagtgtggctgccctgtcctacaacctgtggttccggtgcctctcctgtgtggacatgaagctgagccttgaggtctcagaacagattctgcacatgatgagtcagtcatcacacctggaggagctggtgctggagacctgcagcctgaggggagactttgtccgacgactggcccaggcgctggcgggacactcaagctctgggctgcgggagctcagcctcgcggggaacctgctggatgaccgaggcatgactgcactcagcagacacctcgagcgttgtccaggagccctgaggagactcagcctggcccagacagggttgacaccgcgaggaatgagggctctgggccgggcactggccaccaatgccgccttcgactccaccctgacccacctggacctttctgggaatcctggggcgctgggggcctccgaggacagtgggggcctctatagcttcctgagccgtcctaacgtactgtcgttcctgaatctcgcaggcaccgacactgccctggacactctcttcgcagcggtatcccgaggctgctgcaccagccttacccacctcgacgcttcgaggaacgtcttctcccgcacgaagtcccgcgccgcgccggccgcgctgcagctcttcctcagccgcgcgcggacgctgcggcacctgggcctggcgggctgcaagctgccgcccgacgcgctcagagcccttttggatggcctcgcgctcaacacgcacctccgcgacctgcacctggacctcagcgcttgcgagctgcgctcggccggcgcccaggtgatacaagacttagtgtgcgacgcaggcgctgtgagctccctggatctggcggataacggcttcggctcagacatggtgactctggtgctggccatcgggagaagccggtccctgagacatgtggcgcttggaaggaacttcaacgtccggtgcaaggagaccctggacgacgtcctgcaccggattgtccagctcatgcaggacgacgattgtcctcttcagtctctgtcggtggctgagtctcggctgaagctgggtgccagcgtcctactccgggccctagccaccaatcctaacctgaccgcgctggatatcagcggcaacgccatgggggacgcgggcgccaagttgctggccaaggcgctgcgggtcaactcgaggctccggtctgtggtctgggaccggaaccacacatctgctttgggtctgctggacgtggcgcaggcgctggagcagaaccacagcctgaaggccatgcctctgccactgaacgacgtggcccaggcgcagcgcagccgcccggaactgacagcacgtgcagtccatcagatccaagcctgtctcttgaggaacaaccgcgcagaccctgcctcttctgaccacacgacccgccttcagccacttggtctggtctcagacccctcagagcaggaagtgaatgaattgtgtcagtcggtgcaggagcatgtggagctgctgggctgtggggctgggccccagggtgaagccgctgtgcgccaggccgaggatgccatccaaaatgccaacttctctctcagcattctccccattctatatgaagctggaagctccccaagccatcactggcagcttgggcagaagctggagggccttctgagacaggtgggcgaggtctgccgccaggacatccaggacttcactcaggccacactggacacagcaaggagcctctgcccacagatgctgcagggatccagctggagggagcagctagagggggtcctggcaggctcgaggggcctcccggagctgctcccagagcagctgctgcaagatgccttcactaggctcagggacatgcggctatcaatcacggggaccttggcagagagcattgtggctcaggctttggcaggcctgagtgcagcccgggatcagctggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggatgacagtcctccacagaaatggcctgagctcagccacggtcttcacctggtccccttcattcacagtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtacccccagccttgccgcaggaagggaatgggctcagtgcccgcgtggacgagggcgtggaggaattcttctccaaaaggctgatccagcaggatcgcctctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaagaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctga

SEQ ID NO: 175574 - DNA, 953 bp, Homo sapiens
  Payload ID: 14486
  Gene Symbol: RLTPR
  Gene Name: RGD motif, leucine rich repeats, tropomodulin domain and proline-rich containing
  ENST ID: ENST00000602368
  CDS Start-End: 1-373
gcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtctggtacctgagtccccagctccgccttgcaggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaagggcggcgagcagtgtctgtgcatgaggaccagctccaggcccctgctgaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctgatcctctcctctcctgccgcatgagattattttattaaaaaactcaaaggaa

SEQ ID NO: 175575 - DNA, 1048 bp, Homo sapiens
  Payload ID: 14486
  Gene Symbol: RLTPR
  Gene Name: RGD motif, leucine rich repeats, tropomodulin domain and proline-rich containing
  ENST ID: ENST00000602563
  CDS Start-End: 260-427
tcctgggcgacggggcgggcgggcaggtgggactcggcccccctcccacaaccccgctcccgggcaagctctcgagccgcgaggccggggcggggaggggccgggccgggggcggcctggcaggaagcggcgcgcaccttccgccgccggaggagcaggtggctgccgtgcgggtctgggccccaggcttcctgtgtgcgcgctcgtcctctgctgtttcccgccggagctcgttgggcctccccggcccgcccggcccatggcccagacccccgacggcatctcctgtgagctccgaggcactgctacgatggagagcctacctgctgcacaccacctgcctcccgctgagggtggactgcacgttcagctacctggaggtccaggccatggcgctgcaggagacaccccctcaggtcacctttgagctggagtccctgcgtgagctggtcctggagtttcctggtgtggccgccctggaacagctggcccagcacgtggctgcagccatcaagaaggtcttccctcgctcgacccttgggaagctattccggaggcccacaccagcctccatgctggctcggctggagagaagcagcccctcggagtccactgacccctgcagcccctgtggtggcttcttggagacatacgaggctctgtgtgactacaatggcttccctttccgagaggagattcagtgggacgtggacaccatttaccatcgccagggctgccgccatttcagcctgggagacttcagccacctcggcagtcgggacctggccttgagtgtggctgccctgtcctacaacctgtggttccggtgcctctcctgtgtggacatgaagctgagccttgaggtctcagaacagattctgcacatgatgagtcagtcatcacacctggaggagctggtgctggagacctgcagcctgaggggagactttgtccgacgactggcccaggcgctggcgggacactcaagctctgggctgcgggagctcagcctcgcggggaacctgctggatgaccgaggtatgactga

SEQ ID NO: 175576 - DNA, 7018 bp, Homo sapiens
  Payload ID: 14487
  Gene Symbol: RGP1
  Gene Name: RGP1 homolog, RAB6A GEF complex partner 1
  Uniprot ID: Q92546
  ENST ID: ENST00000378078
  CDS Start-End: 142-1317
agtcccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacctggggaaccaaggataggggaaggagtcagcacagtgaaaggctgcctttatccctgcccacatgttccctctctcacagttttccccccacagagcccctttcagtggccccttggtcctcctaactaagctgtcacctaccatatgtgggcctttttgttttataacaggagtattttctctccaggtccaccccaacctcccctgatttatagcctgaagccttatctttcacactagtgttggtcccttcaggtttggcccatcttgtattgctcttctgttcattcttacatcacagcaatctagtcactccctggtcatccctcagtcactcatatcagagtcattctctctggccatctttggtcactcacgtgtcacagcagcccacgccaacaggatgcagacaggtgcaatggaaacagtccttgcggagccaagactcacccagggtaaaatatttcccctcatagtgacagggggctagggaagaacgggaaatgttagtaggtgtaggagtgctgatgagaggcagaggctcttctggtctggggtggagacagtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcgagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatg

SEQ ID NO: 175577 - DNA, 1616 bp, Homo sapiens
  Payload ID: 14488
  Gene Symbol: RHCE
  Gene Name: Rh blood group, CcEe antigens
  ENST ID: ENST00000243186
  CDS Start-End: 87-1283
atcgctccctcaagccctcaagtaggtgttggagagaggggtgatgcctggtgctggtggaacccctgcacagagacggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaatttta

SEQ ID NO: 175578 - DNA, 1591 bp, Homo sapiens
  Payload ID: 14488
  Gene Symbol: RHCE
  Gene Name: Rh blood group, CcEe antigens
  Uniprot ID: P18577
  ENST ID: ENST00000294413
  CDS Start-End: 60-1313
gttggagagaggggtgatgcctggtgctggtggaacccctgcacagagacggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaatttta

SEQ ID NO: 175579 - DNA, 1810 bp, Homo sapiens
  Payload ID: 14488
  Gene Symbol: RHCE
  Gene Name: Rh blood group, CcEe antigens
  ENST ID: ENST00000349320
  CDS Start-End: 390-1595
atgcccggggcgtgtgcggcggtgcggcccgggctccacgtccacaggctgggcagcgctgtgggccccgcgggcgccgagtccgcaggacccgcgagggcactaccgcgaagcatcggcctccgggccgggccgggccggaccgggagcctgctcggcgggtccgggctcctgcaaggcggggacgcggggccggcgacccttcacgcttcgtactcattgagcgccgattttatgccaggcaccgtgctggatctcccagtgcctggaagagaaaacccattctgtttcgaagggcatccagagctggtcacagtggggacccaccctccttttccaggctacgccagaccctgggtgtgtgtacgtttcaatggaagtgaatttaaatgtactttataaatcaaagactttttctgagactttggagagttccagtaatgagagcttctcattgttatcaaagccagggctggagaccagtggcagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcatt

SEQ ID NO: 175580 - DNA, 1235 bp, Homo sapiens
  Payload ID: 14488
  Gene Symbol: RHCE
  Gene Name: Rh blood group, CcEe antigens
  ENST ID: ENST00000349438
  CDS Start-End: 20-1084
gcacagagacggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagca

SEQ ID NO: 175581 - DNA, 971 bp, Homo sapiens
  Payload ID: 14488
  Gene Symbol: RHCE
  Gene Name: Rh blood group, CcEe antigens
  ENST ID: ENST00000346452
  CDS Start-End: 7-807
cacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacgtgtgttgtaaccgagtgctggggattcaccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaa

SEQ ID NO: 175582 - DNA, 1087 bp, Homo sapiens
  Payload ID: 14488
  Gene Symbol: RHCE
  Gene Name: Rh blood group, CcEe antigens
  ENST ID: ENST00000340849
  CDS Start-End: 10-813
ggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcatgtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattagga

SEQ ID NO: 175583 - DNA, 1253 bp, Homo sapiens
  Payload ID: 14488
  Gene Symbol: RHCE
  Gene Name: Rh blood group, CcEe antigens
  ENST ID: ENST00000374352
  CDS Start-End: 1-909
atgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggtgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaa

SEQ ID NO: 175584 - DNA, 1198 bp, Homo sapiens
  Payload ID: 14488
  Gene Symbol: RHCE
  Gene Name: Rh blood group, CcEe antigens
  ENST ID: ENST00000413854
  CDS Start-End: 21-1139
tgcacagagacggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcatgtttgctcctaaatctcaaaatatggaaagcacctcatgtggctaaatattttgatgaccaagttttctggaagtttcctcatttggctgttggattttaagcaa

SEQ ID NO: 175585 - DNA, 456 bp, Homo sapiens
  Payload ID: 14488
  Gene Symbol: RHCE
  Gene Name: Rh blood group, CcEe antigens
  ENST ID: ENST00000527747
  CDS Start-End: 1-233
cgggtgctgtcttggggaaggtcaacttggcgcagttggtggtgatggtgctggtggaggtgacagctttaggcaccctgaggatggtcatcagtaatatcttcaacgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaactta

SEQ ID NO: 175586 - DNA, 581 bp, Homo sapiens
  Payload ID: 14488
  Gene Symbol: RHCE
  Gene Name: Rh blood group, CcEe antigens
  ENST ID: ENST00000533771
  CDS Start-End: 11-178
cggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcat

SEQ ID NO: 175587 - DNA, 2930 bp, Homo sapiens
  Payload ID: 14489
  Gene Symbol: RHD
  Gene Name: Rh blood group, D antigen
  Uniprot ID: Q02161
  ENST ID: ENST00000328664
  CDS Start-End: 156-1409
aactccatagagaggccagcacaaccagccttgcagcctgagataaggcctttggcgggtgtctcccctatcgctccctcaagccctcaagtaggtgttggagagaggggtgatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcatgattggcttccaggtcctcctcagcattggggaactcagcttggccatcgtgatagctctcatgtctggtctcctgacaggtttgctcctaaatcttaaaatatggaaagcacctcatgaggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagctaaggttaatttattattattccttgtttttttttttttttttttttttttgagatgtagtcttactctgtcacccaggctagagtgcaatggcaccatcttggctcactgcaacctctacctcctgggttcaagcaaatctcctgcctcagcctccaaagtagctgggattacaggcacccaccacatctggctaattttttgtatttttagtaaagatggggtttcaccatgttggccaggctgatctcaaactcctgacctcaagtgatctgcccgcctcggcctcccaaagtgctggaaccacaggcctgagccactgtgcccagccttgtttgcttttttaacagataacagtgtgctcatagaaactgctttgacatgactgcaatcatgtgcttcatagaaacttaattagattataccactagagtcttcagatttttatactttttttttttgaaacggagtctcactctgtcaccaggctggagtgcagtgccgcaatctcggctcactgcaacctccgcctcccaggttcaagcaattctcctgcctcagcctcccgagtagctggaattacaagtgcgcactaccacacccagctaatttttgcatttttacttgacagggtttcaccatgttggctaggatagtttcaccaggatctcttggcctcatgatcagcctgcctcggcctcccaaagtgctgggattacaggtgtgagccaccgtgcccagcctatacttccctttttgaataccatttggtgttttgaagaattaacagctttgtgaacgtggcagtgcttgtgattcaggcttccattgagaccaaggggagaacctggttgcaggacaaacagacggacagcgtgtggcagtgtttaaatgctcttctgaaggctgatacgacagctctctgtgcactgattgcatatgcatcccaagattatattattgttttctactgctatgtgtcacactttgccaaacaggatgtggaaaatgaataagcggttttcttaggcacttcttaacagacaattggtcaaaatgaactccattgcttaagaaacacataaacaccatttagtcactgaacatagctatatgtatggttgttactatgggaaatcttgttttgccaattttctttgaaaattctggcagaccaaggttctttttgtttacataatacttgaaaaataaaaatgaacaagctaacaaacta

SEQ ID NO: 175588 - DNA, 1557 bp, Homo sapiens
  Payload ID: 14489
  Gene Symbol: RHD
  Gene Name: Rh blood group, D antigen
  Uniprot ID: Q02161
  ENST ID: ENST00000342055
  CDS Start-End: 1-1482
atgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcatgtcactcggctggaacctggctgtaaaaatggctgaagcaggtgatgaggagctgatgcgtttggacgtgtctcagagaaatcatggaggcgctgcggttcctaccggttcttggatgccttctacagagacaaccatagccccaaattatagggatcacatatcagtggtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagc

SEQ ID NO: 175589 - DNA, 1387 bp, Homo sapiens
  Payload ID: 14489
  Gene Symbol: RHD
  Gene Name: Rh blood group, D antigen
  Uniprot ID: Q02161
  ENST ID: ENST00000357542
  CDS Start-End: 1-1191
atgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcattttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagc

SEQ ID NO: 175590 - DNA, 1333 bp, Homo sapiens
  Payload ID: 14489
  Gene Symbol: RHD
  Gene Name: Rh blood group, D antigen
  Uniprot ID: Q02161
  ENST ID: ENST00000417538
  CDS Start-End: 1-1137
atgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggattggcttccaggtcctcctcagcattggggaactcagcttggccatcgtgatagctctcatgtctggtctcctgacagtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagc

SEQ ID NO: 175591 - DNA, 1637 bp, Homo sapiens
  Payload ID: 14489
  Gene Symbol: RHD
  Gene Name: Rh blood group, D antigen
  ENST ID: ENST00000423810
  CDS Start-End: 1-1296
atgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcatgtcactcggctggaacctggctgtaaaaatggctgaagcaggtgatgaggagctgatgcgtttggacgtgtctcagagaaatcatggaggcgctgcggttcctaccggttcttggatgccttctacagagacaaccatagccccaaattatagggatcacatatcagtgggattggcttccaggtcctcctcagcattggggaactcagcttggccatcgtgatagctctcatgtctggtctcctgacagtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagc

SEQ ID NO: 175592 - DNA, 1303 bp, Homo sapiens
  Payload ID: 14489
  Gene Symbol: RHD
  Gene Name: Rh blood group, D antigen
  Uniprot ID: Q02161
  ENST ID: ENST00000454452
  CDS Start-End: 51-1016
aggggtgatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccgtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagc

SEQ ID NO: 175593 - DNA, 1467 bp, Homo sapiens
  Payload ID: 14489
  Gene Symbol: RHD
  Gene Name: Rh blood group, D antigen
  ENST ID: ENST00000568195
  CDS Start-End: 1-1392
atgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcatgattggcttccaggtcctcctcagcattggggaactcagcttggccatcgtgatagctctcatgtctggtctcctgacagtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagc

SEQ ID NO: 175594 - DNA, 3007 bp, Homo sapiens
  Payload ID: 14489
  Gene Symbol: RHD
  Gene Name: Rh blood group, D antigen
  ENST ID: ENST00000622561
  CDS Start-End: 63-1358
ggtgttggagagaggggtgatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcatgtcactcggctggaacctggctgtaaaaatggctgaagcaggtgatgaggagctgatgcgtttggacgtgtctcagagaaatcatggaggcgctgcggttcctaccggttcttggatgccttctacagagacaaccatagccccaaattatagggatcacatatcagtgggattggcttccaggtcctcctcagcattggggaactcagcttggccatcgtgatagctctcatgtctggtctcctgacaggtttgctcctaaatcttaaaatatggaaagcacctcatgaggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagctaaggttaatttattattattccttgtttttttttttttttttttttttttgagatgtagtcttactctgtcacccaggctagagtgcaatggcaccatcttggctcactgcaacctctacctcctgggttcaagcaaatctcctgcctcagcctccaaagtagctgggattacaggcacccaccacatctggctaattttttgtatttttagtaaagatggggtttcaccatgttggccaggctgatctcaaactcctgacctcaagtgatctgcccgcctcggcctcccaaagtgctggaaccacaggcctgagccactgtgcccagccttgtttgcttttttaacagataacagtgtgctcatagaaactgctttgacatgactgcaatcatgtgcttcatagaaacttaattagattataccactagagtcttcagatttttatactttttttttttgaaacggagtctcactctgtcaccaggctggagtgcagtgccgcaatctcggctcactgcaacctccgcctcccaggttcaagcaattctcctgcctcagcctcccgagtagctggaattacaagtgcgcactaccacacccagctaatttttgcatttttacttgacagggtttcaccatgttggctaggatagtttcaccaggatctcttggcctcatgatcagcctgcctcggcctcccaaagtgctgggattacaggtgtgagccaccgtgcccagcctatacttccctttttgaataccatttggtgttttgaagaattaacagctttgtgaacgtggcagtgcttgtgattcaggcttccattgagaccaaggggagaacctggttgcaggacaaacagacggacagcgtgtggcagtgtttaaatgctcttctgaaggctgatacgacagctctctgtgcactgattgcatatgcatcccaagattatattattgttttctactgctatgtgtcacactttgccaaacaggatgtggaaaatgaataagcggttttcttaggcacttcttaacagacaattggtcaaaatgaactccattgcttaagaaacacataaacaccatttagtcactgaacatagctatatgtatggttgttactatgggaaatcttgttttgccaattttctttgaaaattctggcagaccaaggttctttttgtttacataatacttgaaaaataaaaatgaacaagctaacaaacta

SEQ ID NO: 175595 - DNA, 1253 bp, Homo sapiens
  Payload ID: 14489
  Gene Symbol: RHD
  Gene Name: Rh blood group, D antigen
  ENST ID: ENST00000615607
  CDS Start-End: 1-909
atgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggtgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcatgattggcttccaggtcctcctcagcattggggaactcagcttggccatcgtgatagctctcatgtctggtctcctgacaggtttgctcctaaatcttaaaatatggaaagcacctcatgaggctaaatattttgatgaccaagttttctggaagtttcctcatttggctgttggattttaa

SEQ ID NO: 175596 - DNA, 1927 bp, Homo sapiens
  Payload ID: 14490
  Gene Symbol: RHBG
  Gene Name: Rh family, B glycoprotein (gene/pseudogene)
  ENST ID: ENST00000451864
  CDS Start-End: 39-332
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggcatcatattggtcttatgcctcctagacccctgtgccctgtggcactgggtggcaccctcctccatggtggggggcagagaagcctcacagatcctcccctaccaccaccagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactgg

SEQ ID NO: 175597 - DNA, 1789 bp, Homo sapiens
  Payload ID: 14490
  Gene Symbol: RHBG
  Gene Name: Rh family, B glycoprotein (gene/pseudogene)
  Uniprot ID: Q9H310
  ENST ID: ENST00000537040
  CDS Start-End: 39-1415
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaa

SEQ ID NO: 175598 - DNA, 1862 bp, Homo sapiens
  Payload ID: 14490
  Gene Symbol: RHBG
  Gene Name: Rh family, B glycoprotein (gene/pseudogene)
  ENST ID: ENST00000612897
  CDS Start-End: 39-500
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaaagagtctcactctgttgcccaggctggagtgcaacggcgcaatctcggctcactgcaaccttcacctcccaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaa

SEQ ID NO: 175599 - DNA, 1984 bp, Homo sapiens
  Payload ID: 14490
  Gene Symbol: RHBG
  Gene Name: Rh family, B glycoprotein (gene/pseudogene)
  ENST ID: ENST00000620376
  CDS Start-End: 1-293
tggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaa

SEQ ID NO: 175600 - DNA, 1912 bp, Homo sapiens
  Payload ID: 14490
  Gene Symbol: RHBG
  Gene Name: Rh family, B glycoprotein (gene/pseudogene)
  ENST ID: ENST00000613460
  CDS Start-End: 39-332
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaa

SEQ ID NO: 175601 - DNA, 1982 bp, Homo sapiens
  Payload ID: 14491
  Gene Symbol: RHCG
  Gene Name: Rh family, C glycoprotein
  Uniprot ID: Q9UBD6
  ENST ID: ENST00000268122
  CDS Start-End: 70-1509
ctcaaaagccccgccggcctccgagcgtccgaaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaaggtgcctccacccctgccctccccttcatcccagggggtctgactgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgtaaaa

SEQ ID NO: 175602 - DNA, 1405 bp, Homo sapiens
  Payload ID: 14491
  Gene Symbol: RHCG
  Gene Name: Rh family, C glycoprotein
  ENST ID: ENST00000558030
  CDS Start-End: 39-740
aaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaa

SEQ ID NO: 175603 - DNA, 1014 bp, Homo sapiens
  Payload ID: 14491
  Gene Symbol: RHCG
  Gene Name: Rh family, C glycoprotein
  ENST ID: ENST00000558360
  CDS Start-End: 1-712
ggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcagggggtctgactgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggca

SEQ ID NO: 175604 - DNA, 1862 bp, Homo sapiens
  Payload ID: 14491
  Gene Symbol: RHCG
  Gene Name: Rh family, C glycoprotein
  ENST ID: ENST00000560081
  CDS Start-End: 28-1023
gccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccgcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggctccacagactgtcctggggcccagaggagctggtgctgacctagctagggatgcaagagtgagcaagcagcacccccacctgctggcttggcctcaaggtgcctccacccctgccctccccttcatcccagggggtctgactgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgtaaaatggtgtgaa

SEQ ID NO: 175605 - DNA, 1388 bp, Homo sapiens
  Payload ID: 14491
  Gene Symbol: RHCG
  Gene Name: Rh family, C glycoprotein
  ENST ID: ENST00000558184
  CDS Start-End: 46-456
gcgtccgaaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacgattctccagggtgggagtcgtccaagtgtcatacataggagggtctcccttcccctacgacaaaggctgcagggacttgaggctagactttcctctgggggcagggtccgaccgggcccggcacatcaaaatcgcccagccctgtgtcctgagagaccgcagcccacgggactctggtgggagaactgggatgtctgcaccagcctcagaggctccttgtgaaggaaacaccgaatggggactccagccaaatggagcctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccgtaagtgccccaggcaaggggctgggggctagagaatgctgaggtctttgtgttcctgacagtgagctgagggttcctagggagggggctgagggctagagaatcctgg

SEQ ID NO: 175606 - DNA, 1283 bp, Homo sapiens
  Payload ID: 14492
  Gene Symbol: RHAG
  Gene Name: Rh-associated glycoprotein
  ENST ID: ENST00000229810
  CDS Start-End: 28-1260
agtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactccactttttactactaaactgaggatccatgatacatgtggggtccataacctccacggcttacctggtgtagtgggaggccttgcaggcattgtggcagtagcaatgggcgcctccaacacgtctatggccatgcaggcagctgcactgggttcctctatcggaacagcagttgttggaggtctgatgacaggtttaattctaaagttgcctctctggggacagccatctgaccagaactgctatgatgattctgtttattggaaggtccctaagacgagagtctaaacaccattcctgctctccagctt

SEQ ID NO: 175607 - DNA, 1912 bp, Homo sapiens
  Payload ID: 14492
  Gene Symbol: RHAG
  Gene Name: Rh-associated glycoprotein
  Uniprot ID: Q02094
  ENST ID: ENST00000371175
  CDS Start-End: 28-1257
agtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactccactttttactactaaactgaggatccatgatacatgtggggtccataacctccacggcttacctggtgtagtgggaggccttgcaggcattgtggcagtagcaatgggcgcctccaacacgtctatggccatgcaggcagctgcactgggttcctctatcggaacagcagttgttggaggtctgatgacaggtttaattctaaagttgcctctctggggacagccatctgaccagaactgctatgatgattctgtttattggaaggtccctaagacgagataacttgacaatcagttccatggacatggtgaccacagccagctggaacctgaagtctaaacaccattcctgctctccagcttcctttcccattatccagaatcaagtccaaataaacaaaaagggagtaaccaaagagagtatggaccagagtgaatagatcctaagtcccaaatggccagtgtaaaaatgtccttatgtctgatgctgtctcttgctcttcaatgattaattgaggggatgttactcataaaacagataatcaaatagatcttctccaggattcccaaaaagcttttggcagtgagtaaatacagagtaaacatgtcagtttcttaatgtagacactatgtcttcaatcccaaaaattataaaactgaaacccatgaagcaagaatagatgtgagaaatctatgtaaaaaaataattaaagaaatgcatgtgtgtaaagtagtaatatgatgattttaggtagtgctttttattttaaaaatagtctagttagtaatgttgtatccttgcatgaatattattcttaattccttttgcatgttgactatttgcaacgagctcaaatgctatctgatcaaagtctattttgcataaaatgtccaataattaaatattgttataaaataaaacatcagtctttgactct

SEQ ID NO: 175608 - DNA, 1203 bp, Homo sapiens
  Payload ID: 14492
  Gene Symbol: RHAG
  Gene Name: Rh-associated glycoprotein
  ENST ID: ENST00000618248
  CDS Start-End: 28-1173
agtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactccactttttactactaaactgaggatccatgatacatgtggggtccataacctccacggcttacctggtgtagtgggaggccttgcaggcattgtggcagtagcaatgggcgcctccaacacgtctatggccatgcaggcagctgcactgggttcctctatcggaacagcagttgttggaggtctgatgacaggaacctgaagtctaaacaccattcctgctctccagctt

SEQ ID NO: 175609 - DNA, 1681 bp, Homo sapiens
  Payload ID: 14493
  Gene Symbol: RND1
  Gene Name: Rho family GTPase 1
  Uniprot ID: Q92730
  ENST ID: ENST00000309739
  CDS Start-End: 132-830
aaaaggcggctgtgccggcctcctcctcagttggagggaggcagggaatctggcttgattggcgtgctgagacgcacctggcgcaaccctcccttctgaatcgaagttcaagtcccgcggacactgcaaccatgaaggagagacgggccccccagccagtcgtggccagatgtaagctcgttctggtcggggacgtgcagtgtgggaagaccgcgatgttgcaagtgttagcgaaggattgctatccagagacctatgtgcccaccgtgttcgaaaattacacagcctgtttggagacagaggaacagagggtggagcttagtctctgggatacctcaggatctccctactacgataatgtccgtccactctgctacagcgactcggatgcagtattactatgttttgacatcagccgtccagagacagtggacagcgcactcaagaagtggaggacagaaatcctagattattgtcccagcacccgcgttttgctcattggctgcaagacagacctgcgaacagacctgagtactctgatggagctgtcccaccagaagcaggcgcccatctcctatgagcagggttgtgcaatagcaaagcagctgggtgcagaaatctacctggaaggctcagctttcacctcagaaaagagcatccacagcatctttcggacggcatccatgctgtgtctgaacaagcctagcccactgccccagaagagccctgtccgaagcctctccaaacgactgctccacctccccagtcgctctgaactcatctcttctaccttcaagaaggaaaaggccaaaagctgttccattatgtgaagtggaaattggaggggggagacaaccccctacttcctcccttggggtgcagaggcacggggagagggaggatgagacaatttaggacactggacatgagtttttcagatggccacggtgagggcttggaaggagacaggaatggggcgaggaaggagccaggcccggcatgaggacctgacgctgagagagaaccatcataccccaagccaggcactagattttggagggggcgactaccccagtgccccccccgctccagaggaaggaaagctgtgggggacggggggcatgctggcctcatgggcttgggggcctacagcagcctcaccttcagcttcatgcctcttccacacagcgtttccatgcaggtcaggggatgggaggggtccctgagcccttcccttcccctctaaggaggcagcaacggagagtggggaagtggagcggcagctcccttgggggcttagcccaggtgcttcgtaactgcaatcggaagtgcaggagctggtcagagccaatgagaaggaaacctcatctttgcatagcccatgcctcatggagaggtgacatcatacattcacatgcttctcacctaagtccccagggtccaagggagaagccccagacccccttctcttgcagagtgtgggggtggtggtgctgcaggggcagggctgggtgggggtcaccagactttttctgcccttagggtagtacagctggcatttgttttatagactcttgtctttggaattggggggagggggggagtgtttcaatctgttatatgttctgtgtttaatgaagaaaacctatttattaatgaaaaatataatacatataaagaa

SEQ ID NO: 175610 - DNA, 552 bp, Homo sapiens
  Payload ID: 14493
  Gene Symbol: RND1
  Gene Name: Rho family GTPase 1
  ENST ID: ENST00000550607
  CDS Start-End: 1-381
tggaggacagaaatcctagattattgtcccagcacccgcgttttgctcattggctgcaagacagacctgcgaacagacctgagtactctgatggagctgtcccaccagaagcaggcgcccatctcctatgagcagggttgtgcaatagcaaagcagctgggtgcagaaatctacctggaaggctcagctttcacctcagaaaagagcatccacagcatctttcggacggcatccatgctgtgtctgaacaagcctagcccactgccccagaagagccctgtccgaagcctctccaaacgactgctccacctccccagtcgctctgaactcatctcttctaccttcaagaaggaaaaggccaaaagctgttccattatgtgaagtgggggtcaccagactttttctgcccttagggtagtacagctggcatttgttttatagactcttgtctttggaattggggggagggggggagtgtttcaatctgttatatgttctgtgtttaatgaagaaaacctatttattaatgaaaaatataatacatataaagaa

SEQ ID NO: 175611 - DNA, 793 bp, Homo sapiens
  Payload ID: 14493
  Gene Symbol: RND1
  Gene Name: Rho family GTPase 1
  ENST ID: ENST00000551243
  CDS Start-End: 89-379
gggaatctggcttgattggcgtgctgagacgcacctggcgcaaccctcccttctgaatcgaagttcaagtcccgcggacactgcaaccatgaaggagagacgggccccccagccagtcgtggccagatgtaagctcgttctggtcggggacgtgcagtgtgggaagaccgcgatgttgcaagtgttagcgaaggattgctatccagaggtgagctgcccgcccgcccgctggccggcttttctccctgcctgcccgccttggggtagatttccacctgctcaggagacgtggctcccccagccccagcccatcctcagccgctttctgaggctttaccatcctcagctgctttttggctggaggactgccctgccttagcttcccctgagacctgttccacttctgccgccccgctggctcctcctcacctcttcacccagaggacccatcagatcccctccaccttcctgcgtccctggagtctgctctcagacctatgtgcccaccgtgttcgaaaattacacagcctgtttggagacagaggaacagagggtggagcttagtctctgggatacctcaggatctccctactacgataatgtccgtccactctgctacagcgactcggatgcagtattactatgttttgacatcagccgtccagagacagtggacagcgcactcaagaagtggaggacagaaatcctagattattgtcccagcacccgcgttttgctcattggctgcaagacagacctgcgaacagacctgagtactctgatggagctgtcc

SEQ ID NO: 175612 - DNA, 4147 bp, Homo sapiens
  Payload ID: 14494
  Gene Symbol: RND2
  Gene Name: Rho family GTPase 2
  Uniprot ID: P52198
  ENST ID: ENST00000587250
  CDS Start-End: 108-791
gagatgccggtgttggcggcccgagcggctgcagttgcaggggcgggggaggcggcggcggggcccgggagaggggtggcgtgggggaccggcgcgtagccgggaccatggaggggcagagcggccgctgcaagatcgtggtggtgggagacgcagagtgcggcaagacggcgctgctgcaggtgttcgccaaggacgcctatcccgggagttatgtccccaccgtgtttgagaactacactgcgagctttgagatcgacaagcgccgcattgagctcaacatgtgggacacttcaggttcctcttactatgataatgtccggcctctggcctatcctgattctgatgctgtgctcatctgcttcgacattagccgaccagaaacactggacagtgttctcaagaagtggcaaggagagactcaagagttctgccccaatgccaaggttgtgctggttggctgtaaactggacatgcggactgacctggccacactgagggagctgtccaagcagaggcttatccctgttacacatgagcagggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggatcgagccaaaagctgcaacctcatgtgaggggctaggagagggcagagtgtgaagaggggtggtgagggacacaattgttcccctgcctgcgcccaggcttcctgacctcctgatcctggctgggaagttagggcaggcagagcgagcaattctgggcaggggagctggagggcagaagggtatcatcgtttctcatctcctcctccctcctcttctccagtggatgttgagggagctaacagggctggcatctggggcatgaactgggatggggcaggtgggcgttagggaagctggtatcaaatggtgaccttggtggagtctcctatgtgaagagtaccctccctctccacccccagtccccatatcctggttctggcccaaggaaaatgtccattctatgaccttctcttttcctctcctctcacttctgcagctattctcacacatctaacctctaggcaacatgcactaaattcaaaagcaaggagaagcccttgccccccatcagtccaccagccctagaacctcccttgcctcaacagtcacctaataaagcccacctccatggaaaacggctgtggctttagttttgttgctttttaaaaaaatcaatctaccaatctttagcagtaagagggaaagttagacctcagctggggaactttcctgtccatgtccacagatagagcagaggacaaagccataggttggatcagaagtgtccttttaggagtcagagttgggagaaggagacatcctgggactgttcatcctagttaatgaagtgggcaattctcaggccattagggggttttagagcagaccgacatataattagtcagcatttctcagcccagccaggcctgctgctagtgtgggaggggtcctgctcaccatctgtacccctggcttggagcctgctggtaccctgggggttgtggggataaggaggcatcaggccgggcgcgctggctcacgcctgtaatcccagcactttgggaggccgaggtgggcggatcacaagttcaggagatcgagaccatcctggctaacacggtgaaaccccatctctactaaaaatacaaaaaattagccaggcgcggtggcagtgcctgtagtcccagctgctcgggaggctgaggcaggagaatggtgtgaacccgggtgaacctgggaggcggagcttgcagtgagccgagattgcgccactgcattctagcctggatgacagagcaagactctgtctccaaaaaaaaaaaaaaaaaaaaaaaagaaggcatcaaaagcctccacatcacagaagctacccctgtacagcgtgaagtttcctaagaggtcagtagtttgattctggggtctccttagaggctcaggccagggacctttctctcctcccatgctgagtttcatgatggctttcaggggagcatcagctgttagagtcacccctaccctgtcccttaaaggaaagacggtggagaggacggctgagcgcctgttgtcaggaaagacagtactggtctgttttctcgggagtctggtttcagattgtcctgtattcccttcctggctctggtcccactggcctcttttcggtgacattctcccccaggaaccatccctggcccttccctcccccagccctagccagttctcccagacacactggaagagaacactgaccttacccaactatctgctgggatcccacccaaatttatagcccattcctccctcattcattcattcagcaagtatgtactgaacaccaactgtgtggcatacactggcttgggagattgcaaggaccagtctctaagcttttggaggccagcccagtgtggaagagaggtacctcaggtgtgagggtgccatggctgagggatatttgtacatgtatgggatgctatgggagctccttgcagcctgagaagccagtcctgtgagccaggtcctgagggttgaagaggagttttccgggcagggaaggggtaggaaaggcactctgggcagagggtacagcatgtgtaaacacgtggagatgagaatgagcatagcactgttggggctcccatggcagggagaatagaagacaaggctaggaaggtacactgaggctactgcagggtccacagaggaatcagaatttcattctgaggatgaatgaaatcatcctcagaggatgaagccaccaggaatttcaggcagagagtgaagtgatcagagttgttttttggatagatggttatctggatgtggtgttggagctgggagatttggctctgaggtgtgtcatttaaaataatagcttctcggcagtggctcacacctataatcccagccaagattcctcctttgggaggccaagctgggaggatcgcttgaggccaggagttagagactgcagtgagctatgatcatgccattgtcttccagcctgagtgtcagagtgagaccctgtctctaaaaaaaattaaaaaataaaaaataaaaaatagcttctcctttcccttatgccaggttccagtcttgagaggaaaggaatccctacccaccactccctggatcatcagatatccctatcccaacctctcctatgggactagttcatctcagccagtctcaaagattctaggataacttcaatggcatttgaaattatctaagtgtgcttggataaccaccccctcaaactgagacctggttagggactgactcaaagaccctgagtcctcggctaagggtacaggagagggcaggggctccaggcccagctaggtggatctccatctgtctctgaggactgaccctttccccacaaggacctgccataaaaatcgacttgcgatttttagctgagtggcttctcttttccactttggacttctcagtgtatagcaggttcaagcctgcaaccaccaaagtgcagagtgtggagtgtttgtgccccctctttcctccaacctccatatcctgccatgtgagctcagggaatgcaaatgcatttaaatatccatctaaagcaaacataattagaaaaatcaatcagctggaggaccccccaaagtttaatacattttcaataccaccaggaatggatttttggtccctttctgcaggtctgggttgccagacgttttatttctggggaggagggctctgggctgaggagctcagtgggtgggaggagggaatgggactgttgctgatcctcaaaggcctctgtaggatggagggaggggaccttactcccttccccaccccagatgcaggagtcacccagcttccttctctgcgctgtttccttcacaaattagacattggtttgggaaacaatgtagcctcgttaaacatttaatgaaataaacaaataatcacac

SEQ ID NO: 175613 - DNA, 2711 bp, Homo sapiens
  Payload ID: 14495
  Gene Symbol: RND3
  Gene Name: Rho family GTPase 3
  Uniprot ID: P61587
  ENST ID: ENST00000263895
  CDS Start-End: 185-919
aaagccgcgcagagagcgtgaaacaaagcagtcggctcggaattggacttgggaggcgcggtgaggagtcaggcttaaaacttgttggaggggagtaaccagcctgctcctctcgctctcctcctcgtctgcgccgcgtttcagagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatactttttttttcttcaaataaaaaagtaaccatgtctttgtctaaa

SEQ ID NO: 175614 - DNA, 2777 bp, Homo sapiens
  Payload ID: 14495
  Gene Symbol: RND3
  Gene Name: Rho family GTPase 3
  Uniprot ID: P61587
  ENST ID: ENST00000375734
  CDS Start-End: 251-985
gcagtcggctcggaattggacttgggaggcgcggtgaggagtcaggcttaaaacttgttggaggggagtaaccagcctgctcctctcgctctcctcctcgtctgcgccgcgtttcagaggttgcccatcagccttgtgatttatttttatatctgctttttataaagagagaaatatatatatatatatatatttttttttttcttcttaagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatactttttttttcttcaaataaaaaagtaaccatgtctttgtctaaa

SEQ ID NO: 175615 - DNA, 2372 bp, Homo sapiens
  Payload ID: 14495
  Gene Symbol: RND3
  Gene Name: Rho family GTPase 3
  ENST ID: ENST00000409557
  CDS Start-End: 247-594
gcttgaaccgctggagcccccgagggacgcgggggttcagagagcaagaggaaggaaccagactgacagggtcgccagaggcagtcccagcacaaaggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatactttttttttcttcaaataaaaaagtaacca

SEQ ID NO: 175616 - DNA, 505 bp, Homo sapiens
  Payload ID: 14495
  Gene Symbol: RND3
  Gene Name: Rho family GTPase 3
  ENST ID: ENST00000439275
  CDS Start-End: 158-505
aatgctgaaggcaaagcaaaagatggtgattttggataaatgagaaaaaggagagagtaataggaagacaagcaagaatcacaaaaggaagcacgctaggtaatatacgatcctcccagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaag

SEQ ID NO: 175617 - DNA, 481 bp, Homo sapiens
  Payload ID: 14495
  Gene Symbol: RND3
  Gene Name: Rho family GTPase 3
  ENST ID: ENST00000454202
  CDS Start-End: 134-481
attgagaaagaagaggattggaaggccgggcgtataaagccgcgcagagagcgtgaaacaaagcagtcggctcggaattggacttgggaggcgcgagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaag

SEQ ID NO: 175618 - DNA, 1906 bp, Homo sapiens
  Payload ID: 14496
  Gene Symbol: ARHGDIA
  Gene Name: Rho GDP dissociation inhibitor (GDI) alpha
  Uniprot ID: P52565
  ENST ID: ENST00000269321
  CDS Start-End: 137-751
gagcggaagtctcgtgaccccggaagtgacaggcagggcgggcggggcggccgacgacgttcgtcatttagtgcgggagggatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcactcaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagga

SEQ ID NO: 175619 - DNA, 1568 bp, Homo sapiens
  Payload ID: 14496
  Gene Symbol: ARHGDIA
  Gene Name: Rho GDP dissociation inhibitor (GDI) alpha
  Uniprot ID: P52565
  ENST ID: ENST00000400721
  CDS Start-End: 107-589
aggcagggcgggcggggcggccgacgacgttcgtcatttagtgcgggagggatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagaacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcactcaccccacctgggcccagccaggagccccgcctggccatcagtatttattgcctccgtccgtgccgtccctgggccactggcctggcgcctgttcccccaggctctcagtgccaccacccccgg

SEQ ID NO: 175620 - DNA, 1517 bp, Homo sapiens
  Payload ID: 14496
  Gene Symbol: ARHGDIA
  Gene Name: Rho GDP dissociation inhibitor (GDI) alpha
  Uniprot ID: P52565
  ENST ID: ENST00000541078
  CDS Start-End: 367-981
cgcgtggggcccgggccagacctgagggcccctccttggggacgcggggggcgccgggccggcagccgcggtccatcgcgttcgggggcgacgcggggattggggcgcggcctcccccagcgcccgggccacgcccggcacggattgcgggccctgcggaagtgcgggccgcgccctaggatcccggcgcctacggctatcctcgcgcggcgcggaggccccagcccctggaggaagcagggcggcctggaccccggcctgggtgtcccgggtgtgctgctccctgacccacctcccacgctgccgggaaggatctgagcctgacagatcccctgccgggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctc

SEQ ID NO: 175621 - DNA, 709 bp, Homo sapiens
  Payload ID: 14496
  Gene Symbol: ARHGDIA
  Gene Name: Rho GDP dissociation inhibitor (GDI) alpha
  ENST ID: ENST00000581876
  CDS Start-End: 55-444
tcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagttgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcc

SEQ ID NO: 175622 - DNA, 815 bp, Homo sapiens
  Payload ID: 14496
  Gene Symbol: ARHGDIA
  Gene Name: Rho GDP dissociation inhibitor (GDI) alpha
  ENST ID: ENST00000583868
  CDS Start-End: 68-815
agtgcgggagggatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatgacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtggggg

SEQ ID NO: 175623 - DNA, 421 bp, Homo sapiens
  Payload ID: 14496
  Gene Symbol: ARHGDIA
  Gene Name: Rho GDP dissociation inhibitor (GDI) alpha
  ENST ID: ENST00000578351
  CDS Start-End: 57-335
gatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggttaaccgagagatagtgtccggcatgaagtacatccagcatacgtacaggaaaggcgtcaagattgacaagactgactacatggtaggca

SEQ ID NO: 175624 - DNA, 637 bp, Homo sapiens
  Payload ID: 14496
  Gene Symbol: ARHGDIA
  Gene Name: Rho GDP dissociation inhibitor (GDI) alpha
  ENST ID: ENST00000579121
  CDS Start-End: 57-637
ggatctgagcctgacagatcccctgccgggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggttctatctccccgtcacacccgaggcctggcttcaggagggagcggagcagccattctccaggccccgtggttgcccc

SEQ ID NO: 175625 - DNA, 547 bp, Homo sapiens
  Payload ID: 14496
  Gene Symbol: ARHGDIA
  Gene Name: Rho GDP dissociation inhibitor (GDI) alpha
  ENST ID: ENST00000580033
  CDS Start-End: 56-334
atcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacct

SEQ ID NO: 175626 - DNA, 886 bp, Homo sapiens
  Payload ID: 14496
  Gene Symbol: ARHGDIA
  Gene Name: Rho GDP dissociation inhibitor (GDI) alpha
  ENST ID: ENST00000584461
  CDS Start-End: 60-767
agggatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccaggg

SEQ ID NO: 175627 - DNA, 1201 bp, Homo sapiens
  Payload ID: 14496
  Gene Symbol: ARHGDIA
  Gene Name: Rho GDP dissociation inhibitor (GDI) alpha
  Uniprot ID: P52565
  ENST ID: ENST00000580685
  CDS Start-End: 77-691
gcctccgttggggatccaggtccaaggcctgtcaccgtcccgcccacaggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgcctta

SEQ ID NO: 175628 - DNA, 1256 bp, Homo sapiens
  Payload ID: 14497
  Gene Symbol: ARHGDIB
  Gene Name: Rho GDP dissociation inhibitor (GDI) beta
  Uniprot ID: P52566
  ENST ID: ENST00000228945
  CDS Start-End: 146-751
ccagggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctga

SEQ ID NO: 175629 - DNA, 463 bp, Homo sapiens
  Payload ID: 14497
  Gene Symbol: ARHGDIB
  Gene Name: Rho GDP dissociation inhibitor (GDI) beta
  ENST ID: ENST00000541380
  CDS Start-End: 126-463
tcagaagggctctgagaacacgcaccgggagtgcctggaggggtttcctgcaaagtaggagcaggcacctggccaggcttggaagaaaaagactgtagatccaaaatgatacgaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcactt

SEQ ID NO: 175630 - DNA, 859 bp, Homo sapiens
  Payload ID: 14497
  Gene Symbol: ARHGDIB
  Gene Name: Rho GDP dissociation inhibitor (GDI) beta
  Uniprot ID: P52566
  ENST ID: ENST00000541546
  CDS Start-End: 240-845
aactgccagtactcagaagtcagagttgagagacagaggcaccccggacagagacgtgaagcactgaataggatgaaactggggcccagtgaggttaagcaacttgcaggaggtaacgcaggaaccgagttgcgctgaaacatcgttatctgacacttccctgctttgttaaagctgtctctgcagagcttgcaaagaagcatttacctctgcttgtgcacctccagaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccct

SEQ ID NO: 175631 - DNA, 911 bp, Homo sapiens
  Payload ID: 14497
  Gene Symbol: ARHGDIB
  Gene Name: Rho GDP dissociation inhibitor (GDI) beta
  Uniprot ID: P52566
  ENST ID: ENST00000541644
  CDS Start-End: 114-719
ggctggctggatttggaggactgtgataactcctacagctttttgactgggcttttgcttcatttgttcaggagtctttgtgccatgttgcttcactcgtaaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacc

SEQ ID NO: 175632 - DNA, 1063 bp, Homo sapiens
  Payload ID: 14497
  Gene Symbol: ARHGDIB
  Gene Name: Rho GDP dissociation inhibitor (GDI) beta
  ENST ID: ENST00000536592
  CDS Start-End: 1-586
agagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactgatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaata

SEQ ID NO: 175633 - DNA, 723 bp, Homo sapiens
  Payload ID: 14497
  Gene Symbol: ARHGDIB
  Gene Name: Rho GDP dissociation inhibitor (GDI) beta
  ENST ID: ENST00000545895
  CDS Start-End: 248-723
cattatcactcagactgtgcatgctgcaagctttgacgctagccaggctggctggatttggaggactgtgataactcctacagctttttgactgggcttttgcttcatttgttcaggagtctttgtgccatgttgcttcactcgtagtacgttattcacatatgagtgatttctttcttgtcagttttgttcagtgaatagaagatactacaatggtacagagaaattcaggcagaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagt

SEQ ID NO: 175634 - DNA, 354 bp, Homo sapiens
  Payload ID: 14497
  Gene Symbol: ARHGDIB
  Gene Name: Rho GDP dissociation inhibitor (GDI) beta
  ENST ID: ENST00000542276
  CDS Start-End: 90-354
gctgctcaagttggctgatcaagagataggcagtgcaaaggaacaggatttgagacagcccagggtttcctcttcaaaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactg

SEQ ID NO: 175635 - DNA, 949 bp, Homo sapiens
  Payload ID: 14498
  Gene Symbol: ARHGDIG
  Gene Name: Rho GDP dissociation inhibitor (GDI) gamma
  Uniprot ID: Q99819
  ENST ID: ENST00000219409
  CDS Start-End: 76-753
gagcgccgagcggggcggcggcggggcgggcggcggctcctcggcggctccgcggcgcccgggccgcgcgccgccatgctgggcctggacgcgtgcgagctgggggcgcagctgctggagctgctccggctggcgctgtgcgcccgagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtggacccaagcctgcccaatgtgcaggtgaccaggctgacactcctgtcggaacaggctccggggcccgtcgtcatggatctcacaggggacctggctgttctgaaggaccaggtgtttgtcctgaaggaaggtgttgattacagagtgaagatctccttcaaggtccacagggagattgtcagcggcctcaagtgtctgcaccacacctaccgccggggcctgcgcgtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgcaccacctgtcctgggagtggggtctctgcatctgccaggactggaaggactgaacccccagtccgtgtctcccctacctccctcagttgttgcacagggacccccaagcatccccagcaccccccgtgagtgaccagaccctcccctgctgcccctgctgcccctgctgcccctgctctgtcccgggaccccctggcctggcgctgtcccctgagctgtcccattaaacatggccctgtctctctcggt

SEQ ID NO: 175636 - DNA, 519 bp, Homo sapiens
  Payload ID: 14498
  Gene Symbol: ARHGDIG
  Gene Name: Rho GDP dissociation inhibitor (GDI) gamma
  ENST ID: ENST00000435035
  CDS Start-End: 111-519
gtgacctcgaggcagcctcagcacggcactctcttgggtcctcttccaggctcacactgggcgacagcggagaggctcttggacggggcagagctcgcgccgagacctgcatgtccgcgtcttgtgacgggtgtgtgggaagccgcccgcctgtgcatcttgcttccgggtattcgctggctgatttactggttttagagatggggatgggcacccagtgctggactgaagaccagagaaggtggagctccctgtggccttggtctcacctctcttcagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtggacccaagcctgcccaatgtgcaggtgaccaggctgacactcctgtcggaacaggctccgg

SEQ ID NO: 175637 - DNA, 765 bp, Homo sapiens
  Payload ID: 14498
  Gene Symbol: ARHGDIG
  Gene Name: Rho GDP dissociation inhibitor (GDI) gamma
  ENST ID: ENST00000447871
  CDS Start-End: 232-765
cggcgggggcgacccgggtgccggcccgtgcgggcgacacgcgcgtctctgcggggctgcgcggggtccggagcggctgggggctctctgccgggcgcggctgggcgcggggggcgctcccggccgggatgagctcaccgcagtcgcgccggggctgagcgccgagcggggcggcggcggggcgggcggcggctcctcggcggctccgcggcgcccgggccgcgcgccgccatgctgggcctggacgcgtgcgagctgggggcgcagctgctggagctgctccggctggcgctgtgcgcccgagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtggacccaagcctgcccaatgtgcaggtgaccaggctgacactcctgtcggaacaggctccggggcccgtcgtcatggatctcacaggggacctggctgttctgaaggaccaggtgtttgtcctgaaggaaggtgttgattacagagtccacagggagattgtcagcggcctcaagtgtctgcaccacacctaccgccggggcctgcgcgtggacaagaccgtctacatggtgggcagctatggcccgagcgcccaggagtatgagtttgtgactccggtggag

SEQ ID NO: 175638 - DNA, 339 bp, Homo sapiens
  Payload ID: 14498
  Gene Symbol: ARHGDIG
  Gene Name: Rho GDP dissociation inhibitor (GDI) gamma
  ENST ID: ENST00000412541
  CDS Start-End: 111-339
gtgacctcgaggcagcctcagcacggcactctcttgggtcctcttccaggctcacactgggcgacagcggagaggctcttggacggggcagagctcgcgccgagacctgcatgtccgcgtcttgtgacgggtgtgtgggaagccgcccgcctgtgcatcttgcttccgggtattcgctggctgatttactggttttagagatggggatgggcacccagtgctggactgaagaccagagaaggtggagctccctgtggccttggtctcacctctcttcagacccaagcctgcccaatgtgcaggtgaccaggctgacactcctgtcggaacaggctccgg

SEQ ID NO: 175639 - DNA, 680 bp, Homo sapiens
  Payload ID: 14498
  Gene Symbol: ARHGDIG
  Gene Name: Rho GDP dissociation inhibitor (GDI) gamma
  ENST ID: ENST00000414650
  CDS Start-End: 331-680
gcggcgccgaccccccggctggggtctggcaggggtgggggacttcatccaggctccagccctgtggggaagggaccagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtggacccaagcctgcccaatgtgcaggtgaccaggctgacactcctgtcggaacaggctccggggcccgtcgtcatggatctcacaggggacctggctgttctgaaggaccaggtgtttgtcctgaaggaaggtgttgattacagagtgaagatctccttcaaggtccacagggagattgtcagcggcctcaagtgtctgcaccacacctaccgccggggcctgcgcgtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgcaccacctgtcctgggagtggggtctctgcatctgccaggactggaagga

SEQ ID NO: 175640 - DNA, 3375 bp, Homo sapiens
  Payload ID: 14499
  Gene Symbol: ARHGAP1
  Gene Name: Rho GTPase activating protein 1
  Uniprot ID: Q07960
  ENST ID: ENST00000311956
  CDS Start-End: 99-1418
gtttgccgagccttgacaggcgtggcagagggagcagtgcccgagcgcggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaaaaacatcaaggccttgtacatcgtgcatccaaccatgttcatcaaaactctgctcatcctcttcaagcccctcatcagcttcaagttcgggcagaagatcttctatgtgaattacctgagcgagctgagcgagcacgtgaagctggagcagctggggatccctcgccaagtgctcaaatatgacgacttcctgaaatccacacagaagagccccgcgacagcccccaagcccatgcccccacggccccccctgcccaaccagcagtttggagtctcgctgcagcacctccaggagaagaatccagagcaggagcccattcccattgtactcagggagactgttgcctacttacaggcccacgctctcaccaccgagggcatcttccggaggtcggccaacacccaagtggtccgggaagtgcagcagaagtacaacatggggctgcctgtggatttcgaccagtacaatgagctgcacctgccagcagtcatcctcaagaccttcctccgggagcttcctgagcccctgctcacctttgacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctctgtttccctagcaagtgtggatgaatcaaatgactgccggctgggctggtagcaggggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcacccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaa

SEQ ID NO: 175641 - DNA, 890 bp, Homo sapiens
  Payload ID: 14499
  Gene Symbol: ARHGAP1
  Gene Name: Rho GTPase activating protein 1
  ENST ID: ENST00000525488
  CDS Start-End: 314-890
gttgctgcccattagggctgagggcagaggtgcctacccccaggctgcatgcggctgcagccttctggccagattccagacctacagaaacccagcttggtggtcgagtctgccttgtgcctgccggagctgctgttctgctggtgacctcctcatctcagcaccccagacatcacgagcatccccctttcccatctgcgccctccaatccttagggccgtcaacctttccaccttgaaactggtgtcaggagcaccctgcagagtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaaaaacatcaaggccttgtacatcgtgcatccaaccatgttcatcaaaactctgctcatcctcttcaagcccctcatcagcttcaagttcgggcagaagatcttctatgtgaattacctga

SEQ ID NO: 175642 - DNA, 1000 bp, Homo sapiens
  Payload ID: 14499
  Gene Symbol: ARHGAP1
  Gene Name: Rho GTPase activating protein 1
  ENST ID: ENST00000528837
  CDS Start-End: 1-1000
gctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacaagaaaaacatcaaggccttgtacatcgtgcatccaaccatgttcatcaaaactctgctcatcctcttcaagcccctcatcagcttcaagttcgggcagaagatcttctatgtgaattacctgagcgagctgagcgagcacgtgaagctggagcagctggggatccctcgccaagtgctcaaatatgacgacttcctgaaatccacacagaagagccccgcgacagcccccaagcccatgcccccacggccccccctgcccaaccagcagtttggagtctcgctgcagcacctccaggagaagaatccagagcaggagcccattcccattgtactcagggagactgttgcctacttacaggcccacgctctcaccaccgagggcatcttccggaggtcggccaacacccaagtggtccgggaagtgcagcagaagtacaacatggggctgcctgtggatttcgaccagtacaatgagctgcacctgccagcagtcatcctcaagaccttcctccgggagcttcctgagcccctgctcacctttgacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgca

SEQ ID NO: 175643 - DNA, 3299 bp, Homo sapiens
  Payload ID: 14500
  Gene Symbol: ARHGAP10
  Gene Name: Rho GTPase activating protein 10
  Uniprot ID: A1A4S6
  ENST ID: ENST00000336498
  CDS Start-End: 240-2600
gagctcggcgggggctgccgggattggggcgccgcagctagcgctggtctcggtggcagctcctccgcgccgcaggactcggctctacgggacatgtccgtgccgcgctcgccgcgcgcccgggcctgctagctcctctgtgctccctgaacgcgcggcgccgcacctggcagcggcctcggagctcggctcgggcaggagcgcgcggccgtgcgcaccgcgcagcgaccgctgccgtcatggggctgcagcccctggagttcagcgactgctacctcgacagcccgtggttccgggagaggatccgcgctcacgaagcggaactcgagaggaccaacaagttcatcaaagagctcattaaggacgggaagaacctcatcgctgcgacgaaaagtctgtcagtggcccagcggaagtttgctcattcactcagagactttaagtttgagtttatcggtgatgctgtgacagatgatgaacgatgcatagatgcttccttacgtgaattttcaaattttttgaagaatctggaggaacagagagaaattatggcattaagtgtaactgaaaccctgattaaacccttggaaaaattcagaaaagagcaacttggagctgtaaaggaagaaaaaaagaagtttgacaaagagacagaaaagaattatagtctaattgataaacatttgaatttatcagcaaaaaagaaagactcacatttacaagaggcagatatccaagtagagcagaaccggcaacacttctatgaactgtctctcgagtatgtgtgtaagctgcaggaaatccaagaaagaaagaagtttgagtttgtggaacctatgctgtcattttttcaggggatgtttaccttctatcatcagggccatgaacttgccaaagacttcaatcactacaaaatggaactacagatcaacattcagaatacacggaatcgatttgaaggaacaaggtcagaagtggaagagctcatgaacaaaatcagacagaatcccaaggaccacaaacgagcaagtcagtttacagccgaaggctacctgtatgtccaggaaaaaaggcctgctccgtttggttccagttgggtcaaacactattgcatgtatcgaaaagcagcaaagaagttcaacatgatcccatttgagcacagatctggagggaaacttggggacggagaggtgttctttttgaaagaatgtaccaagaggcatactgactccattgacagaaggttttgttttgacatagaagctgctgatcggcctggcgtttccttgaccatgcaggcattttccgaagaggaaaggaagcagtggttggaagctctgggtggaaaggaagctctgtcccatagttttaatacagccatcatcccaagaccagaaggaaatgcacagttggataagatggggttcacaattatcagaaaatgcatcagtgccgttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaagaataaagagatgttggatattttggtgaaacacttaacaaatgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatcccaggccagacccgatcgtctatggtccagtggcttaacccacagtctccaaccacaacaagctccaactcagctgtgacacctctttcacccgggtcgtcccctttccccttttctcctcctgctactgtagcggacaagccacctgaaagcatccgcagtcggaaggctcgagccgtgtatccgtgtgaagcagaacacagctcggaattatcttttgaaataggagcaatttttgaggatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttactatttg

SEQ ID NO: 175644 - DNA, 1934 bp, Homo sapiens
  Payload ID: 14500
  Gene Symbol: ARHGAP10
  Gene Name: Rho GTPase activating protein 10
  ENST ID: ENST00000507661
  CDS Start-End: 1-1240
atgtaccaagaggcatactgactccattgacagaaggttttgttttgacatagaagctgctgatcggcctggcgtttccttgaccatgcaggcattttccgaagaggaaaggaagcagtggttggaagctctgggtggaaaggaagctctgtcccatagttttaatacagccatcatcccaagaccagaaggaaatgcacagttggataagatggggttcacaattatcagaaaatgcatcagtgccgttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaagaataaagagatgttggatattttggtgaaacacttaacaaatgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatcatccgcagtcggaaggctcgagccgtgtatccgtgtgaagcagaacacagctcggaattatcttttgaaataggagcaatttttgaggatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttact

SEQ ID NO: 175645 - DNA, 5898 bp, Homo sapiens
  Payload ID: 14501
  Gene Symbol: ARHGAP11A
  Gene Name: Rho GTPase activating protein 11A
  Uniprot ID: Q6P4F7
  ENST ID: ENST00000361627
  CDS Start-End: 723-3794
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgacgttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatgggttcttctcactgtcttataaatgtaaataaagatctaatattaatttggtta

SEQ ID NO: 175646 - DNA, 3152 bp, Homo sapiens
  Payload ID: 14501
  Gene Symbol: ARHGAP11A
  Gene Name: Rho GTPase activating protein 11A
  Uniprot ID: Q6P4F7
  ENST ID: ENST00000543522
  CDS Start-End: 590-3094
ggcttcagtgaacgcaccgggatgtgcaggccgggagagcgaaccagacggggacagtaaggtttggaggaagggggatcgttggaagtagcaagaagtggagagaatctggcaatagacgagaaaccgaaagaatcagaaagaagtctatggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgc

SEQ ID NO: 175647 - DNA, 2422 bp, Homo sapiens
  Payload ID: 14501
  Gene Symbol: ARHGAP11A
  Gene Name: Rho GTPase activating protein 11A
  Uniprot ID: Q6P4F7
  ENST ID: ENST00000567348
  CDS Start-End: 674-2179
agctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgactta

SEQ ID NO: 175648 - DNA, 620 bp, Homo sapiens
  Payload ID: 14501
  Gene Symbol: ARHGAP11A
  Gene Name: Rho GTPase activating protein 11A
  ENST ID: ENST00000562481
  CDS Start-End: 1-620
attttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaattcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacagga

SEQ ID NO: 175649 - DNA, 3318 bp, Homo sapiens
  Payload ID: 14501
  Gene Symbol: ARHGAP11A
  Gene Name: Rho GTPase activating protein 11A
  Uniprot ID: Q6P4F7
  ENST ID: ENST00000565905
  CDS Start-End: 549-3053
aagaacggtttcttcataagagggccttcagcgacagccaagctcggaaaagaacgggaataagttgtcttttatatttcctcaaatactgtgaatggtctgaggcgcagggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctga

SEQ ID NO: 175650 - DNA, 2279 bp, Homo sapiens
  Payload ID: 14501
  Gene Symbol: ARHGAP11A
  Gene Name: Rho GTPase activating protein 11A
  ENST ID: ENST00000563864
  CDS Start-End: 648-2069
cggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaa

SEQ ID NO: 175651 - DNA, 5898 bp, Homo sapiens
  Payload ID: 14501
  Gene Symbol: ARHGAP11A
  Gene Name: Rho GTPase activating protein 11A
  Uniprot ID: Q6P4F7
  ENST ID: ENST00000619401
  CDS Start-End: 723-3794
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcaccgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgacgttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatgggttcttctcactgtcttataaatgtaaataaagatctaatattaatttggtta

SEQ ID NO: 175652 - DNA, 5279 bp, Homo sapiens
  Payload ID: 14501
  Gene Symbol: ARHGAP11A
  Gene Name: Rho GTPase activating protein 11A
  Uniprot ID: Q6P4F7
  ENST ID: ENST00000611363
  CDS Start-End: 671-3175
gaaactgcgggtgtgacccccccgtggtggctctgggtgtctgcggaggagctgggggcggaagcatgaggctaacggcttggcttcagtgaacgcaccgggatgtgcaggccgggagagcgaaccagacggggacagtaaggtttggaggaagggggatcgttggaagtagcaagaagtggagagaatctggcaatagacgagaaaccgaaagaatcagaaagaagtctatggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcaccgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgacgttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatgggttcttctcactgtcttataaatgtaaataaagatctaatattaatttggtta

SEQ ID NO: 175653 - DNA, 5157 bp, Homo sapiens
  Payload ID: 14501
  Gene Symbol: ARHGAP11A
  Gene Name: Rho GTPase activating protein 11A
  Uniprot ID: Q6P4F7
  ENST ID: ENST00000622253
  CDS Start-End: 549-3053
aagaacggtttcttcataagagggccttcagcgacagccaagctcggaaaagaacgggaataagttgtcttttatatttcctcaaatactgtgaatggtctgaggcgcagggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcaccgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgacgttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatgggttcttctcactgtcttataaatgtaaataaagatctaatattaatttggtta

SEQ ID NO: 175654 - DNA, 5898 bp, Homo sapiens
  Payload ID: 14501
  Gene Symbol: ARHGAP11A
  Gene Name: Rho GTPase activating protein 11A
  ENST ID: ENST00000633634
  CDS Start-End: 723-3794
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctcgcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgcaatacggagtattacagaaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatggcttcttctcactgtcttataaatgtaaataaagatctaatattaatttggtta

SEQ ID NO: 175655 - DNA, 1017 bp, Homo sapiens
  Payload ID: 14502
  Gene Symbol: ARHGAP11B
  Gene Name: Rho GTPase activating protein 11B
  Uniprot ID: Q3KRB8
  ENST ID: ENST00000428041
  CDS Start-End: 146-949
gggggtcggggccgcagaagtgccagacggggccggaaagcagccgagcggagttcaaatttgagagcgtttggaaattggaagacttggtggcgaacgagggtcaggacctgcatcctgcctcagagttatcgacgtatccggaatgtgggatcagaggctggtgaagttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaagggcgtgtaccagactttatcctggaaaagataccagccatgttgggtattgatggtctctgtgctactccatcactggaaggctttgaagaaggtgaatatgaaactcctggtgaatataagagaaagagaagacaacgtgtaggagattttgttagtggagcactaaataaatttaaacctaacagaacaccttctattacacctcaacaa

SEQ ID NO: 175656 - DNA, 2043 bp, Homo sapiens
  Payload ID: 14502
  Gene Symbol: ARHGAP11B
  Gene Name: Rho GTPase activating protein 11B
  Uniprot ID: Q3KRB8
  ENST ID: ENST00000563110
  CDS Start-End: 622-1425
ccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttctcttcacatttcagagcgaaccagacggacagtaaggtttggaggaagggggatcgttggaagtagcaggaagtggagagaatctggcaataggcgagaaaccgaaagaatcagaaagaagtctatgtgagtagctgaaagcattgggtgaccagaaagaaggtcgctgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagttatcgacgtatccggaatgtgggatcagaggctggtgaagttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaagggcgtgtaccagactttatcctggaaaagataccagccatgttgggtattgatggtctctgtgctactccatcactggaaggctttgaagaaggtgaatatgaaactcctggtgaatataagagaaagagaagacaacgtgtaggagattttgttagtggagcactaaataaatttaaacctaacagaacaccttctattacacctcaacaagaaagaattgataatgaaacaaccaccatcggttaaatttgatccaaaaatattgcatctaccagcattttcagtggataagttataatttctgaaagaccaagattggaatgactttttgtaacaagtgtgctcgcagatcgactccagtgagaagagctcggggacctcctgagccaagtttaatctcctttgctatttgtgcatggtggctggtcaccaggaggtggccaccaggcttctcctttccccgctgttctaattgctaatccagtatttgcggatagctccaaactgggatatgaccaccattgtatatgcagaccattgactggaacatcatgatctatctgcacatgactgtaaataacaactattggatgtggcacagatggaagctacataaacactctatacaatatggccaattcaccgggctccctgttagtcttgtgagcaattttaaactcttccacgattctttctctgctttggagtgtttcaattaattctccattatattacaatttacatttttattaagccttta

SEQ ID NO: 175657 - DNA, 2042 bp, Homo sapiens; identical to SEQ ID NO: 103651
  Payload ID: 14502
  Gene Symbol: ARHGAP11B
  Gene Name: Rho GTPase activating protein 11B
  Uniprot ID: Q3KRB8
  ENST ID: ENST00000622744
  CDS Start-End: 622-1425

SEQ ID NO: 175658 - DNA, 4625 bp, Homo sapiens
  Payload ID: 14503
  Gene Symbol: ARHGAP12
  Gene Name: Rho GTPase activating protein 12
  Uniprot ID: Q8IWW6
  ENST ID: ENST00000311380
  CDS Start-End: 20-2404
gagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaatttta

SEQ ID NO: 175659 - DNA, 4128 bp, Homo sapiens
  Payload ID: 14503
  Gene Symbol: ARHGAP12
  Gene Name: Rho GTPase activating protein 12
  Uniprot ID: Q8IWW6
  ENST ID: ENST00000344936
  CDS Start-End: 236-2776
agcctgcggggacgggccggccgcggccgtagccgtgtgaacgctcttcgggctcgcgtcgtcgacccgcagccgcggggcggactaagaagggagccgcctgctgcgaggccgccgggctcccggtttaaatgtgatactggtgtagatctccttgttctaagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagccagcagtccaaaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagaga

SEQ ID NO: 175660 - DNA, 4958 bp, Homo sapiens
  Payload ID: 14503
  Gene Symbol: ARHGAP12
  Gene Name: Rho GTPase activating protein 12
  ENST ID: ENST00000375245
  CDS Start-End: 305-2704
gtcacgtgagccccgcccccgcgccggcgcgctccgacgtgccctgtaacttaccctccctcagaggccagcctgcggggacgggccggccgcggccgtagccgtgtgaacgctcttcgggctcgcgtcgtcgacccgcagccgcggggcggactaagaagggagccgcctgctgcgaggccgccgggctcccggtttaaatgtgatactggtgtagatctccttgttctaagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagccagcagtccaaaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttatttgttagtaagtcttccttcataatgtcattg

SEQ ID NO: 175661 - DNA, 4914 bp, Homo sapiens
  Payload ID: 14503
  Gene Symbol: ARHGAP12
  Gene Name: Rho GTPase activating protein 12
  Uniprot ID: Q8IWW6
  ENST ID: ENST00000375250
  CDS Start-End: 243-2693
agaggccagcctgcggggacgggccggccgcggccgtagccgtgtgaacgctcttcgggctcgcgtcgtcgacccgcagccgcggggcggactaagaagggagccgcctgctgcgaggccgccgggctcccggtttaaatgtgatactggtgtagatctccttgttctaagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaatttta

SEQ ID NO: 175662 - DNA, 5084 bp, Homo sapiens
  Payload ID: 14503
  Gene Symbol: ARHGAP12
  Gene Name: Rho GTPase activating protein 12
  Uniprot ID: Q8IWW6
  ENST ID: ENST00000396144
  CDS Start-End: 305-2830
gtcacgtgagccccgcccccgcgccggcgcgctccgacgtgccctgtaacttaccctccctcagaggccagcctgcggggacgggccggccgcggccgtagccgtgtgaacgctcttcgggctcgcgtcgtcgacccgcagccgcggggcggactaagaagggagccgcctgctgcgaggccgccgggctcccggtttaaatgtgatactggtgtagatctccttgttctaagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttatttgttagtaagtcttccttcataatgtcattg

SEQ ID NO: 175663 - DNA, 586 bp, Homo sapiens
  Payload ID: 14503
  Gene Symbol: ARHGAP12
  Gene Name: Rho GTPase activating protein 12
  ENST ID: ENST00000454919
  CDS Start-End: 1-586
cagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaag

SEQ ID NO: 175664 - DNA, 1775 bp, Homo sapiens
  Payload ID: 14504
  Gene Symbol: ARHGAP15
  Gene Name: Rho GTPase activating protein 15
  Uniprot ID: Q53QZ3
  ENST ID: ENST00000295095
  CDS Start-End: 168-1595
gcctttttcttcccccagtactgaaattaagcagcatccaacacaggcctactcttacgacatgtgactttactgttttccgtttttgttgaaagagtcattaacagttaggagttgatggcagtttcaataacaggtcattgccgagaaaaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattacccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtctagatgttgatggaatatatcgagttagtggcaatctggcaacaatacagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 175665 - DNA, 2968 bp, Homo sapiens
  Payload ID: 14504
  Gene Symbol: ARHGAP15
  Gene Name: Rho GTPase activating protein 15
  ENST ID: ENST00000409869
  CDS Start-End: 178-594
attgaacaaagtattttgaggtgcatttgtgtgtgcttgatacttgctccttttgattcaggtcagaatattaaatataagctcagtttctacaactggtttggcagaaatcaaatccgagtttgtctacagtgattcagaggggaccaggcctttcgcgatggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgagcttctgcttgatgtgttcaggaggcacctgaccatgttcatgggatttggcaaatctccatttttggttaaacaaaacccatttgatggattgcatcatagagaagaagctctgcaatttagaacatccattcatttattctctcaacagttaacaactcctaccaggtgtcatataatttttttctttttgttttgttttgtttttacattaggggcaacagaaatattcaaatgaatagtatatgatccctgctcttaaagtactcacaatatggtaaaagagacataattttgtataggtttattataataaaaccatgactaaagtgttaaaaaatattagacaacatgccatggaaccatagatttagctataggtagtctttttccagagaaactattgttgcaagtcatgttcagcttaggtatctctccttttgttcaaatattactgtttgatattattatatcaaatattattgagcatctcttatgtttaagtcactacgataggtgttctgaaagataaaaaatgaaccagactgaaacaaatagaaagtatggccttagattgagtatagtgaagaaatggatgttggtagttgtcctaaaatggcatgaacagagacatggcgtcgttttatgataactcaagagaagagtgtgattgcttccatttggacaggatttgaaatatattcatggaggaagtgacatttgagcacatttctgaaggatgtataggattttgatgtaaaagggggcaaaagatattttatgtactaataagagagtaattaatagtgaactatggaaaattctttttttgttgtttattttacagatgtatattgatctcttgccttcttccatgcactgtgtactagtcactgttcttgaaatgtttgaatgggggttccctgaggcctggagtgaatatttcctagtccagagtattttgtgtttcttctctaagttgcctgggagtgaggaacagctttagactaagttgcggaacagcattgtggaacagcaaacagtgtaatttggttagaaagtcagtgtggaaccggtttaggaaagactttgaacaggattgggagaagagatcatttcattctgtaggtaatgtggggtttttgtaaccaatatgaaatattctcaaattaagagagactcagagttttcagagacatgtttagggaactgatatatatatcagttgtctataaaattaagtctctcttaattttgtgtatatataacttaaaaacacatgcaggacttggtaaattatccgagagacatgttctaaaaatttatgcaaatagatgtgagcaataaggcctgagctcttacgacagagaaaattgtaaaacggctgtgtgtcatcattttggctcaatgcatttagtaaatcacaggacatcttttcactgacaaaatattttgatattctcatatgtctctgacctccaacagtatggccatttctaaagacgttctagtgcaaagagaacaagcagagctatccatctaaggagagcgaaaaacatgctgtcccaagaactaggtgtgtcaccatctcagtgagcacccgttgcaaacctactggtgcttccatctgactccagaacatctgtttagtgtcacaccctacttaaacaaatgcattgtgtgaagtctttccaccaacaatcagacgctgtggaactcattgtcaccaattgggtggatgagagccaccgtttctattatattcatcacacactgctcagaaaatttagtgtcacttttgatataaattcaaaaacattgtaaacattttagggaatattttccccctaaaatggtgtggttctaaagccagtatattcagtagaaagcctatatgttggttgtgtaagggacttttttgttactcttatgttttttattttacattgtactaatatgtatttttaatcagagccaacaactggcaatttttactttttaaaaattatatttttgggttttacatttaagtctttaatccatcttgagttaatttttgtatatggtgtaaggaaggggtccagtttcaattttctgcatatggttacccagttccccacatttattaaataaactataaaaactctagaatgaaatctaggcaataccattcaggacataggcacagacaaagattttatgatgaaaatgccaaaagcaattgtaataaaagcaaatggtgacaaatggggtctaattaaactaaagagcttccgcacagcaaaagtaactatcatcagagtgaacagacaactttcagaatgggagacaatttttgcaatctattcagctgacaaaattctaatatccagagtctataaggaacttaaacaaatgtacaagaaa

SEQ ID NO: 175666 - DNA, 345 bp, Homo sapiens
  Payload ID: 14504
  Gene Symbol: ARHGAP15
  Gene Name: Rho GTPase activating protein 15
  ENST ID: ENST00000419455
  CDS Start-End: 1-170
gtctagatgttgatggaatatatcgagttagtggcaatctggcaacaatacagaagttaagatttattgtcaaccaagtcgtttctggaataccagcccttctatcagaactggatggagacctgtggacacccctagtaagctgcagatttttcacagtggtcatttgacctccagagcaagccaataatttgtcacttcattaaactgaagagaagctgaatttggacgacagccagtgggaggacatccacgttgtcaccggagcactgaagatgtttttccgggagctgcctgagccgctcttcccttacagtttctttgagcagtttgtggaagcgatca

SEQ ID NO: 175667 - DNA, 3461 bp, Homo sapiens
  Payload ID: 14505
  Gene Symbol: ARHGAP17
  Gene Name: Rho GTPase activating protein 17
  Uniprot ID: Q68EM7
  ENST ID: ENST00000289968
  CDS Start-End: 71-2716
gtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttatatgaaaacttc

SEQ ID NO: 175668 - DNA, 3219 bp, Homo sapiens
  Payload ID: 14505
  Gene Symbol: ARHGAP17
  Gene Name: Rho GTPase activating protein 17
  Uniprot ID: Q68EM7
  ENST ID: ENST00000303665
  CDS Start-End: 71-2482
gtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttatatg

SEQ ID NO: 175669 - DNA, 810 bp, Homo sapiens
  Payload ID: 14505
  Gene Symbol: ARHGAP17
  Gene Name: Rho GTPase activating protein 17
  ENST ID: ENST00000455311
  CDS Start-End: 178-810
gggaagcgatgtagtagctgccaggctgtcccccgccctgcccggcccgagccccgcgggccgccgccgccaccgccgccatgaagaagcagttcaaccgcatgaagcagctggctaaccagaccgtgggcaggaaaattaaagaaataatgctgagaggaaggtagacgtgtggtaatggcggctgatgtttcaaggaacagtttacaagcacatgataatttcttagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattcttt

SEQ ID NO: 175670 - DNA, 645 bp, Homo sapiens
  Payload ID: 14505
  Gene Symbol: ARHGAP17
  Gene Name: Rho GTPase activating protein 17
  ENST ID: ENST00000571480
  CDS Start-End: 77-451
agcgatgtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctgggatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaag

SEQ ID NO: 175671 - DNA, 1135 bp, Homo sapiens
  Payload ID: 14505
  Gene Symbol: ARHGAP17
  Gene Name: Rho GTPase activating protein 17
  ENST ID: ENST00000571406
  CDS Start-End: 1-287
cgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagatgcccttcctagtgccctcacaggtggggaaggtttccaggactaagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaa

SEQ ID NO: 175672 - DNA, 1467 bp, Homo sapiens
  Payload ID: 14505
  Gene Symbol: ARHGAP17
  Gene Name: Rho GTPase activating protein 17
  ENST ID: ENST00000573765
  CDS Start-End: 1-706
taaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggttt

SEQ ID NO: 175673 - DNA, 602 bp, Homo sapiens
  Payload ID: 14505
  Gene Symbol: ARHGAP17
  Gene Name: Rho GTPase activating protein 17
  ENST ID: ENST00000573625
  CDS Start-End: 40-255
ccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacgtatttaacctcctttagaaaggcagcataaccaaaagaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatact

SEQ ID NO: 175674 - DNA, 574 bp, Homo sapiens
  Payload ID: 14505
  Gene Symbol: ARHGAP17
  Gene Name: Rho GTPase activating protein 17
  ENST ID: ENST00000573449
  CDS Start-End: 345-574
aagtgctgagattacaacgttgaaccactgcgccctgctagaaacagcttttcatacgttgaaataaacgagagggtgaccgggcagcgttggggtcggggaggccaggcggaggaggcctagtggtcttctcgcccggggccttctagctcttcgcccgtgtcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccag

SEQ ID NO: 175675 - DNA, 1292 bp, Homo sapiens
  Payload ID: 14505
  Gene Symbol: ARHGAP17
  Gene Name: Rho GTPase activating protein 17
  ENST ID: ENST00000571843
  CDS Start-End: 1-385
cccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagatgtatgacctgccatattcagtaagaactgagattggaatatttaatgactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttata

SEQ ID NO: 175676 - DNA, 4462 bp, Homo sapiens
  Payload ID: 14506
  Gene Symbol: ARHGAP18
  Gene Name: Rho GTPase activating protein 18
  Uniprot ID: Q8N392
  ENST ID: ENST00000368149
  CDS Start-End: 90-2081
aatgctaatgagcgagttgccaggcgagacaggaacttctttccccttctctgtgtcaggatcgcagaaagtatgtcccttctctcaccatgagctggctctccagttcccagggagtggtactaacagcctaccaccccagcggcaaggaccagaccgtcgggaacagccatgcaaaggcaggggaggaagccacctcgagtcgcagatatggccagtacactatgaaccaggaaagcaccaccatcaaagttatggagaagcctccatttgatcgatcaatttcccaggattctttggatgaactatctatggaagactattggatagaactagaaaacatcaagaaatctagtgaaaacagccaagaagatcaagaggtggttgttgtcaaagagcctgatgagggagaattggaagaagagtggcttaaagaggccggtttatccaatctcttcggagagtctgctggagatccacaggaaagcattgtgtttttatcaacattgacgcggacccaggcagcagcagttcagaagcgagtagagacggtctcccagaccttgaggaaaaaaaacaaacagtaccagattcctgacgtcagagacatatttgctcaacagagagaatcaaaagaaacagctccaggtggcactgaatcgcagtcacttagaacaaatgaaaacaaataccaaggaagagatgacgaggcatctaaccttgttggtgaagagaagctgatcccacctgaggagacgcctgcccctgaaacagacatcaacctggaggtatcatttgccgagcaagcactcaatcagaaagagagctccaaggagaaaatccagaagagcaaaggcgatgatgccacattacctagtttcagattgccaaaagacaaaacgggtaccacaaggattggtgacctcgcaccccaggacatgaagaaagtttgccatttagccctaattgagctgactgccctctatgatgtattgggtattgagctgaaacaacaaaaagctgtgaaaatcaaaacaaaagattctggtcttttttgcgttccattgacagcgctattagaacaagatcagaggaaagtaccaggaatgcgaatacccttgatctttcaaaaactgatttctcgaattgaagagagaggtttggaaacagaaggcctcttacggatccctggagctgccattagaatcaagaatctttgccaagaactagaagcaaagttttatgaagggacttttaattgggaaagtgtcaaacagcatgatgccgccagcctgctgaagctcttcattcgggagttgccccagccactgctcagtgtggagtatctcaaagcctttcaggctgtccagaatcttccaaccaagaagcagcaactacaggctttgaaccttcttgtcatcctcctacctgatgcaaacagggacacactgaaggcccttcttgaatttctccaaagagtaatagataataaagaaaaaaataaaatgacagtcatgaatgtagcaatggtcatggccccgaatctctttatgtgtcatgcattgggattgaagtccagtgaacagcgagaatttgtaatggcagctgggacagcaaataccatgcacttattgattaagtaccaaaaacttctgtggacaattcccaagtttattgtaaaccaagtgaggaagcaaaacacggaaaatcataaaaaggataaaagagccatgaagaaattgctgaagaaaatggcttatgaccgagaaaaatatgaaaagcaagataagagtacaaatgatgctgacgttcctcagggagtgattcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttttaatatgtggaaatgtcttctcttcccattcttttctcctaaaatcatatatactgtaatatatgctctctcacctctattacctcctcacatctaccctttcccagttaggtttgctttttgaccaaaaagataacaaataccaggtatggcaagttgtgaagacagcacattaaaacatacctaatttcacagtattcctgtcacgacagaatgttagtattcatctctttgaatcatttgctcaaataataacattccaccttttcctgctgtatcacaggaagtgatttgcattttttttcagttcatctgacttatgttcacagaaccgtatcagcgaccaagaaaataggactgtcagaagctgccagttattactgaaccattaaatacttatatactaagaataaataaaatatacccatgtgaaataataattggattatggataacaagagagtgaaagccaaagcactttctgtctactgtactcttctaaatggaattttaaaagtcatagctggctttacgtgttgtcattattagcattataaatatgcatgatagtataatccagtaatggttgaagaatgtattttacttaaagagggatttttttttttaagtcctgaataagtctactggaagaattattcttctgggtgaaaaagcttttgtttgtgttcttattttaaataatcggagtcaatttattaaaatgttcttgaaagtactattcccagggattttaatgcacaaaccatattgtgacaagagatgagcctctgtactgtaaataagaaatgaagtagagaaatgttaaatattttatgagtttagaatatagtaaataaaaggtgatgtaaatgaatgctgcacaaacggtgttcatgatacttttagtagtactttaggaaaaactacacattctcagaagctcttgatgtctctaatgaagggggggaatgctgttaatgagaacagtcataaatttttagcatataattacaagaacagcctgtggatatgatcacttaaatgattttgtggtgattcgtgccattgcttttttatttaaaagaaaattttgtaattaaatgcctttttctaaattatcttctcttggaatcattacttttaatcctatgtgtttatgagtatttttgctttttttttattaatattgagaaatggacttttttgttattaaaagtcacctctattttctattttctttgtaatttttaaagtaggaagatgtcagagatgtaaatatgttttcgtctttagtttttttccttttacaaatttttattcttcaggattttcaaaatacagtttagtctgtttctttgacaatatgtattaatttcccaattagcaaaatggtacttattagtgggttgaaaacaattaataatataaaagaaaaattaagtgcttaaaacattttaggagtatacaacttcaaaaaaaaagatagcagtgaggataatgatttaagtaaaaggttgtctgaagcatatgccaactaaatttcgcaacgtttgctacctacctgaaaaggagggtcaggagggagacacaacatatttttgatcatgaaaaagtatcttaattttaaaaaagtgaaaatgccattttattttgaatcccttttagaactcacgacccaagttcatcaatgttgaataatatcacgtttaaataacaaaaaaatatggactttaaaaaatctcaaattttttagagacagggtcttgctctgttttccagattggagtacagcagtgcattcgcggctaactgcagcctcaagcactggggctcaagcaaacctcctgcctcagcctcgtgagtagctaggaccacaggtgcatgccaccatgcctggctctaaagagaaaaaaaacttgataccatagagccttgaatataaatatcctgatgttaacctactgcttttgctgtgattttttttccttagtgagttttaaatctcaggctagatttttatttgtttttctgtgtgtgtatgagacaaaataaaaataaatatatttgccttgagtttaaaa

SEQ ID NO: 175677 - DNA, 5390 bp, Homo sapiens
  Payload ID: 14507
  Gene Symbol: ARHGAP19
  Gene Name: Rho GTPase activating protein 19
  Uniprot ID: Q14CB8
  ENST ID: ENST00000358308
  CDS Start-End: 47-1444
ggggcgggacgtaaggtggggcggtgaaagaagtttgctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctgaacttgttatcttcattcaatttcctcttgactaaaacatctctggtgccaacgtaatacttctgaaccaaatcactgtgactcaaggaaagtcactgacagcataagagaagtttgctaaaatatttgtatgtgggggaagctctggagtgtgcctaggagggggctggctgcctttatgtcccaggatgactctttatgggtgggattacattgcaccctctgagggtgcaggctagaccgtctcctgagaggaagttaggatcagaaagaagaagcaagcagcaacctctgcagggctgacaggatttaaaggagagaatgttcttatttggaagcagctgtggcttgtcaccaatgttcaaggagtgttactgttccgccctctctttgtcagaagggacacaggtggtaatttggagatggggccagagcttctggcttttggatttggtgtgttcacttgtgttggatagagcagtggcatggctttgacctagtatgaactggtgtctgcccagagagcagcatgtagcaggggggaatgctcaggtttgtgcctggctctgtggagctgtacaacccttctcaccctgtgggttggagccgagtcaggccactatggggaagcagttgccccacaaaatgtggtttgctgacctatttctaaactgttgaatatgctgcaccattgctgaaatgaaagatgactctgggggagcagagcttggccttgtgcccagctggcagccccctctgccagcctttctgctgcttttgctgctgtaacagcaatagtggagaaaaatgtaaaatttggtcttccagcttaatgcagtgtgaacaatagatggttaggaaaacaaaactgcttagaagcccctttctctagagcagttttatgtcatttgtaaaaacacatattagcaaattcgtttgcgtaggtttctattaaatatttgactttttttttcttattaagaaaatgaaatcccttacaccagatatcagttaattcaaacagaaaaccctttgggtatcaccaaattgaaatggtattcttccttaactcttccttctttcctttatttgtttagacgtgcttcatcccgaagtggtgctatggtctgttaaacagggctggcatcaggtagagggagcagagtggtgacctgatagctcctgtcatcgtgttagtttttgattctatttaagggaagtagctgagatttagacggatgtagatgctctttgggtgaatggaatcataagcaaaggttgtgttctggggtgaggatcatgagagagatatttatcacatgcacatgcctttatatagctggtctccttgggtggtttatgtgtgttttgtttatttattgaatatgttttcccttgctttaggggttttataggtcatttttcttaatagaagctgtgatcgacttagaatccaaatttgaggagtaagcagcataaccttctaccttgtaatatgtaactattctaatccagtggaatcttacggaaaacacagagaaaaccccttttatcatttgccacagaaggctgctgtctcccttctgatttggtgggcaggtattgtttttgagccagtatttaacagagttttttaatctataagattttttttgaatctatttcattgtgtttgtttttcatgttggaacaatctctctggaagtgcctcttcttgtggcttttacaacttcatttctttctggggtcacctgtgatgggctttgatgtggtgtcaatttggggccttgtgtttgtgccagagggatacacatattaaactgcaggccaccttcctggtccagactgtactgtgtgaaccccactgactaaattagtgagaaccataggcgttggaatttctcaccttttacaatgatagacttttgcattgggaccaatgaatctggtgtgaaaaaccctgctgtagtagtgaaagagcatcaggagatactgactgtacctgagggccaaaacaggagcaggtaacgaaccgtaaaaaaaggagcaggtaatgaatcgtaaccaaaactacagttgatcctccgcaaaggaaagctctttacccagaatgtccttccagagtcattcaggaaggacaagggaacacccttgggaaatgggctagtggagggctgttgactgcagtgacacctgggtgctccggaggtatctgttctgttgacctgtaaggaagcagtcgatcctagagtgtcagaacagagccattctctcctcctgagtaggaacgtttctgttcagtttccctcacagcagcctgtgttagcatgcagttgaaaatactgccgtctaggagaacctgtggtcactgggaacgtgccccacagtgactggccatgcaaccaggtgatttttaggaatagatgtctctagactctgtctcctttcctacaaggcctcacacagatgcttgaggctaatggcccccattctgaggtcatttttgtgtagaactcctttccccaggagagagccttatctctgccctcctttaccctgaaggcttcaaacggaagacaggacctagatctaaacctagatactagcattttgtgggattgtctagaatttggggaagatttgggttcctaagatgcacaagcgttttacaccagtggtgattaactcaactaaaacccactgtaggaagttagcttccccagacagctaatgccgagatcttctaccagcgtagagttgacagaagcaggccagcgaggaggtgtgggacataatagcctgagtgcttgggttaccatggagactggagtgtgtgaggccacagcctgtgctaaagagccatggagccctcccctggccatgtctggggacagatagaacctgttgggggaaatattccctcaccccagggttctttctgcagagcaagggttgcctttgtcctatccctgagcttgctcaacaagagaaacaaggtttcttaagtgttttggttaaagttttcattcttatttgactatgtatatgtaattgtaaagaaacgatcctatgcattgtctttcttttatattcttgtaatattctgaaattaaaattgttttgtttcatatcc

SEQ ID NO: 175678 - DNA, 5463 bp, Homo sapiens
  Payload ID: 14507
  Gene Symbol: ARHGAP19
  Gene Name: Rho GTPase activating protein 19
  Uniprot ID: Q14CB8
  ENST ID: ENST00000358531
  CDS Start-End: 30-1514
ggggcggtgaaagaagtttgctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctgaacttgttatcttcattcaatttcctcttgactaaaacatctctggtgccaacgtaatacttctgaaccaaatcactgtgactcaaggaaagtcactgacagcataagagaagtttgctaaaatatttgtatgtgggggaagctctggagtgtgcctaggagggggctggctgcctttatgtcccaggatgactctttatgggtgggattacattgcaccctctgagggtgcaggctagaccgtctcctgagaggaagttaggatcagaaagaagaagcaagcagcaacctctgcagggctgacaggatttaaaggagagaatgttcttatttggaagcagctgtggcttgtcaccaatgttcaaggagtgttactgttccgccctctctttgtcagaagggacacaggtggtaatttggagatggggccagagcttctggcttttggatttggtgtgttcacttgtgttggatagagcagtggcatggctttgacctagtatgaactggtgtctgcccagagagcagcatgtagcaggggggaatgctcaggtttgtgcctggctctgtggagctgtacaacccttctcaccctgtgggttggagccgagtcaggccactatggggaagcagttgccccacaaaatgtggtttgctgacctatttctaaactgttgaatatgctgcaccattgctgaaatgaaagatgactctgggggagcagagcttggccttgtgcccagctggcagccccctctgccagcctttctgctgcttttgctgctgtaacagcaatagtggagaaaaatgtaaaatttggtcttccagcttaatgcagtgtgaacaatagatggttaggaaaacaaaactgcttagaagcccctttctctagagcagttttatgtcatttgtaaaaacacatattagcaaattcgtttgcgtaggtttctattaaatatttgactttttttttcttattaagaaaatgaaatcccttacaccagatatcagttaattcaaacagaaaaccctttgggtatcaccaaattgaaatggtattcttccttaactcttccttctttcctttatttgtttagacgtgcttcatcccgaagtggtgctatggtctgttaaacagggctggcatcaggtagagggagcagagtggtgacctgatagctcctgtcatcgtgttagtttttgattctatttaagggaagtagctgagatttagacggatgtagatgctctttgggtgaatggaatcataagcaaaggttgtgttctggggtgaggatcatgagagagatatttatcacatgcacatgcctttatatagctggtctccttgggtggtttatgtgtgttttgtttatttattgaatatgttttcccttgctttaggggttttataggtcatttttcttaatagaagctgtgatcgacttagaatccaaatttgaggagtaagcagcataaccttctaccttgtaatatgtaactattctaatccagtggaatcttacggaaaacacagagaaaaccccttttatcatttgccacagaaggctgctgtctcccttctgatttggtgggcaggtattgtttttgagccagtatttaacagagttttttaatctataagattttttttgaatctatttcattgtgtttgtttttcatgttggaacaatctctctggaagtgcctcttcttgtggcttttacaacttcatttctttctggggtcacctgtgatgggctttgatgtggtgtcaatttggggccttgtgtttgtgccagagggatacacatattaaactgcaggccaccttcctggtccagactgtactgtgtgaaccccactgactaaattagtgagaaccataggcgttggaatttctcaccttttacaatgatagacttttgcattgggaccaatgaatctggtgtgaaaaaccctgctgtagtagtgaaagagcatcaggagatactgactgtacctgagggccaaaacaggagcaggtaacgaaccgtaaaaaaaggagcaggtaatgaatcgtaaccaaaactacagttgatcctccgcaaaggaaagctctttacccagaatgtccttccagagtcattcaggaaggacaagggaacacccttgggaaatgggctagtggagggctgttgactgcagtgacacctgggtgctccggaggtatctgttctgttgacctgtaaggaagcagtcgatcctagagtgtcagaacagagccattctctcctcctgagtaggaacgtttctgttcagtttccctcacagcagcctgtgttagcatgcagttgaaaatactgccgtctaggagaacctgtggtcactgggaacgtgccccacagtgactggccatgcaaccaggtgatttttaggaatagatgtctctagactctgtctcctttcctacaaggcctcacacagatgcttgaggctaatggcccccattctgaggtcatttttgtgtagaactcctttccccaggagagagccttatctctgccctcctttaccctgaaggcttcaaacggaagacaggacctagatctaaacctagatactagcattttgtgggattgtctagaatttggggaagatttgggttcctaagatgcacaagcgttttacaccagtggtgattaactcaactaaaacccactgtaggaagttagcttccccagacagctaatgccgagatcttctaccagcgtagagttgacagaagcaggccagcgaggaggtgtgggacataatagcctgagtgcttgggttaccatggagactggagtgtgtgaggccacagcctgtgctaaagagccatggagccctcccctggccatgtctggggacagatagaacctgttgggggaaatattccctcaccccagggttctttctgcagagcaagggttgcctttgtcctatccctgagcttgctcaacaagagaaacaaggtttcttaagtgttttggttaaagttttcattcttatttgactatgtatatgtaattgtaaagaaacgatcctatgcattgtctttcttttatattcttgtaatattctgaaattaaaattgttttgtttcatatccaga

SEQ ID NO: 175679 - DNA, 2301 bp, Homo sapiens
  Payload ID: 14507
  Gene Symbol: ARHGAP19
  Gene Name: Rho GTPase activating protein 19
  Uniprot ID: Q14CB8
  ENST ID: ENST00000371027
  CDS Start-End: 31-1488
aagctttcttcctgtctcttcgatttaccaatgcctcatcagaaactttcagcacttattgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctg

SEQ ID NO: 175680 - DNA, 5525 bp, Homo sapiens
  Payload ID: 14507
  Gene Symbol: ARHGAP19
  Gene Name: Rho GTPase activating protein 19
  ENST ID: ENST00000492211
  CDS Start-End: 1-902
cgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatggtctcgttttgttgcccacgctggaggagagtaacacaatcactactcactgtagcctcatctaaagtcttttaaacaacttgttgacctggaggtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctgaacttgttatcttcattcaatttcctcttgactaaaacatctctggtgccaacgtaatacttctgaaccaaatcactgtgactcaaggaaagtcactgacagcataagagaagtttgctaaaatatttgtatgtgggggaagctctggagtgtgcctaggagggggctggctgcctttatgtcccaggatgactctttatgggtgggattacattgcaccctctgagggtgcaggctagaccgtctcctgagaggaagttaggatcagaaagaagaagcaagcagcaacctctgcagggctgacaggatttaaaggagagaatgttcttatttggaagcagctgtggcttgtcaccaatgttcaaggagtgttactgttccgccctctctttgtcagaagggacacaggtggtaatttggagatggggccagagcttctggcttttggatttggtgtgttcacttgtgttggatagagcagtggcatggctttgacctagtatgaactggtgtctgcccagagagcagcatgtagcaggggggaatgctcaggtttgtgcctggctctgtggagctgtacaacccttctcaccctgtgggttggagccgagtcaggccactatggggaagcagttgccccacaaaatgtggtttgctgacctatttctaaactgttgaatatgctgcaccattgctgaaatgaaagatgactctgggggagcagagcttggccttgtgcccagctggcagccccctctgccagcctttctgctgcttttgctgctgtaacagcaatagtggagaaaaatgtaaaatttggtcttccagcttaatgcagtgtgaacaatagatggttaggaaaacaaaactgcttagaagcccctttctctagagcagttttatgtcatttgtaaaaacacatattagcaaattcgtttgcgtaggtttctattaaatatttgactttttttttcttattaagaaaatgaaatcccttacaccagatatcagttaattcaaacagaaaaccctttgggtatcaccaaattgaaatggtattcttccttaactcttccttctttcctttatttgtttagacgtgcttcatcccgaagtggtgctatggtctgttaaacagggctggcatcaggtagagggagcagagtggtgacctgatagctcctgtcatcgtgttagtttttgattctatttaagggaagtagctgagatttagacggatgtagatgctctttgggtgaatggaatcataagcaaaggttgtgttctggggtgaggatcatgagagagatatttatcacatgcacatgcctttatatagctggtctccttgggtggtttatgtgtgttttgtttatttattgaatatgttttcccttgctttaggggttttataggtcatttttcttaatagaagctgtgatcgacttagaatccaaatttgaggagtaagcagcataaccttctaccttgtaatatgtaactattctaatccagtggaatcttacggaaaacacagagaaaaccccttttatcatttgccacagaaggctgctgtctcccttctgatttggtgggcaggtattgtttttgagccagtatttaacagagttttttaatctataagattttttttgaatctatttcattgtgtttgtttttcatgttggaacaatctctctggaagtgcctcttcttgtggcttttacaacttcatttctttctggggtcacctgtgatgggctttgatgtggtgtcaatttggggccttgtgtttgtgccagagggatacacatattaaactgcaggccaccttcctggtccagactgtactgtgtgaaccccactgactaaattagtgagaaccataggcgttggaatttctcaccttttacaatgatagacttttgcattgggaccaatgaatctggtgtgaaaaaccctgctgtagtagtgaaagagcatcaggagatactgactgtacctgagggccaaaacaggagcaggtaacgaaccgtaaaaaaaggagcaggtaatgaatcgtaaccaaaactacagttgatcctccgcaaaggaaagctctttacccagaatgtccttccagagtcattcaggaaggacaagggaacacccttgggaaatgggctagtggagggctgttgactgcagtgacacctgggtgctccggaggtatctgttctgttgacctgtaaggaagcagtcgatcctagagtgtcagaacagagccattctctcctcctgagtaggaacgtttctgttcagtttccctcacagcagcctgtgttagcatgcagttgaaaatactgccgtctaggagaacctgtggtcactgggaacgtgccccacagtgactggccatgcaaccaggtgatttttaggaatagatgtctctagactctgtctcctttcctacaaggcctcacacagatgcttgaggctaatggcccccattctgaggtcatttttgtgtagaactcctttccccaggagagagccttatctctgccctcctttaccctgaaggcttcaaacggaagacaggacctagatctaaacctagatactagcattttgtgggattgtctagaatttggggaagatttgggttcctaagatgcacaagcgttttacaccagtggtgattaactcaactaaaacccactgtaggaagttagcttccccagacagctaatgccgagatcttctaccagcgtagagttgacagaagcaggccagcgaggaggtgtgggacataatagcctgagtgcttgggttaccatggagactggagtgtgtgaggccacagcctgtgctaaagagccatggagccctcccctggccatgtctggggacagatagaacctgttgggggaaatattccctcaccccagggttctttctgcagagcaagggttgcctttgtcctatccctgagcttgctcaacaagagaaacaaggtttcttaagtgttttggttaaagttttcattcttatttgactatgtatatgtaattgtaaagaaacgatcctatgcattgtctttcttttatattcttgtaatattctgaaattaaaattgttttgtttcatatccaga

SEQ ID NO: 175681 - DNA, 601 bp, Homo sapiens
  Payload ID: 14507
  Gene Symbol: ARHGAP19
  Gene Name: Rho GTPase activating protein 19
  ENST ID: ENST00000466484
  CDS Start-End: 9-601
tgacgaagatggcgactgaggcacagagtgaaggggaggtgccagcccgcgaatccggccggagtgatgccatctgcagttttgtgatctgcaatgattcttcccttcgagaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtt

SEQ ID NO: 175682 - DNA, 6189 bp, Homo sapiens
  Payload ID: 14508
  Gene Symbol: ARHGAP20
  Gene Name: Rho GTPase activating protein 20
  Uniprot ID: Q9P2F6
  ENST ID: ENST00000260283
  CDS Start-End: 286-3861
gaggcgcgtgtccgtgcactagaggcccccgtgcgtgacacaggccgatgagctcctgcgggctgcacccacgcggagtcacagaccgaaaagcccgcggtgtcgagcgcaggcggaggtacatggccccgacgggaggcgcgcggcgagcacccggagctcggctccctgcctgagcacggcagccgcgcctccgcccgcgcgtcctcgcccctccggccggcagcccgcggacatgatcgtgtagcctcctcctgggctgggatttgtttgaagattttcttcatggaagcgatgtccccccagcaggagactctagggggacagccggggcgctcctcttccctgacaggagtgtctcggctcgcgggaggcagctgcaccaagaagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcagaattaaccatcc

SEQ ID NO: 175683 - DNA, 5998 bp, Homo sapiens
  Payload ID: 14508
  Gene Symbol: ARHGAP20
  Gene Name: Rho GTPase activating protein 20
  Uniprot ID: Q9P2F6
  ENST ID: ENST00000527598
  CDS Start-End: 215-3682
gtagccttctcaatagcttagccaaatttcggcgtcctcgctctgtctgcattttccttcattgctctttcacgtttggaatgcccccgtctctgcagcctgcagacagcggaaaccgcgggtgcaaatgtgcaggggccgctgacatgaccggctgcagaagcccactcagggttacccgaacaggctagcgttcgggattgcacaagagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 175684 - DNA, 6180 bp, Homo sapiens
  Payload ID: 14508
  Gene Symbol: ARHGAP20
  Gene Name: Rho GTPase activating protein 20
  Uniprot ID: Q9P2F6
  ENST ID: ENST00000524756
  CDS Start-End: 358-3864
acagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaagtggcctgggcgagcactgactgccctttggcggtgtcagccccaaagtcagggccggcgatgtctgcccgggagcggcagccggcgctgaagaagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 175685 - DNA, 5880 bp, Homo sapiens
  Payload ID: 14508
  Gene Symbol: ARHGAP20
  Gene Name: Rho GTPase activating protein 20
  Uniprot ID: Q9P2F6
  ENST ID: ENST00000528829
  CDS Start-End: 97-3564
gaggcgcgtgtccgtgcactagaggcccccgtgcgtgacacaggccgatgagctcctgcgggctgcacccacgcggagtcacagaccgaaaagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 175686 - DNA, 6066 bp, Homo sapiens
  Payload ID: 14508
  Gene Symbol: ARHGAP20
  Gene Name: Rho GTPase activating protein 20
  Uniprot ID: Q9P2F6
  ENST ID: ENST00000533353
  CDS Start-End: 253-3750
gtagccttctcaatagcttagccaaatttcggcgtcctcgctctgtctgcattttccttcattgctctttcacgtttggaatgcccccgtctctgcagcctgcagacagcggaaaccgcgggtgcaaatgtgcaggggccgctgacatgaccggctgcagaagcccactcagggttacccgaacaggctagcgttcgggattgcacaagagccaaatttgcctgtgaaataaagatagtagtatctacccggatgacattttggattataataaataagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 175687 - DNA, 2623 bp, Homo sapiens
  Payload ID: 14508
  Gene Symbol: ARHGAP20
  Gene Name: Rho GTPase activating protein 20
  ENST ID: ENST00000529591
  CDS Start-End: 331-2526
gttttctgcccccacattcttggaaatgctctacatttttggaaacacctacagtcaaaatgagctttaagcagagcttttgaccttagcagtatcttctgcagacctgtgtcaggctctcacctcccaaaggattggaatgcaccagagctaggggtcgagacaaggccccagcctgtatctcaggctgaaacgtgaaaaccaagttaaggaaaatatggtgaagaagattcttgcatacccctactccagctgagtgcccaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacagaaactgctgctaacttttaaagttgtttggttttcaaggcactgataatggatatgtatgaagtccatgctgtctgttaaataaaatgccattctgcagaattaaccatc

SEQ ID NO: 175688 - DNA, 3526 bp, Homo sapiens
  Payload ID: 14509
  Gene Symbol: ARHGAP21
  Gene Name: Rho GTPase activating protein 21
  ENST ID: ENST00000376410
  CDS Start-End: 29-3526
ttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcgggtaggagacaccagcccaccggatttcctcaagtcattaattcagttttga

SEQ ID NO: 175689 - DNA, 4343 bp, Homo sapiens
  Payload ID: 14509
  Gene Symbol: ARHGAP21
  Gene Name: Rho GTPase activating protein 21
  Uniprot ID: Q5T5U3
  ENST ID: ENST00000320481
  CDS Start-End: 95-4318
aattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcactggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcagtaaagcagagtttcatccctgtctttaaactgggggtatgtccactctagcaa

SEQ ID NO: 175690 - DNA, 7167 bp, Homo sapiens
  Payload ID: 14509
  Gene Symbol: ARHGAP21
  Gene Name: Rho GTPase activating protein 21
  Uniprot ID: Q5T5U3
  ENST ID: ENST00000396432
  CDS Start-End: 488-6364
gcgggatcgtccggctgcggggtccggctcacgccgggcgggcgggcggggcgcgctgtcccggagccggccagccccgtgcggatccactcgtcccgcttcctctggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtgctacagtttacaaaggatgtcacagcactggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcagtaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaattttg

SEQ ID NO: 175691 - DNA, 590 bp, Homo sapiens
  Payload ID: 14509
  Gene Symbol: ARHGAP21
  Gene Name: Rho GTPase activating protein 21
  ENST ID: ENST00000418033
  CDS Start-End: 1-590
aaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttattcagctactagtgactcaacaaaatctaagggttcttggggatctggaaaggatcagtatagcagggaactgcttgtgtcctccatctttgcagctgctagtcg

SEQ ID NO: 175692 - DNA, 801 bp, Homo sapiens
  Payload ID: 14509
  Gene Symbol: ARHGAP21
  Gene Name: Rho GTPase activating protein 21
  ENST ID: ENST00000416305
  CDS Start-End: 1-540
ggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtgaatctggaattctctacattttacaaaaataccattgccaagtttttgcaattaagtgacatggaaatgttatgttgattctacagtgaactcttaatgctctcatttagaatgagattcctaaagagtttgtcctagtgttgccttctagttcatccttggaccaaaggaagagtttagagtgcaagtgcatatccccaggaattagaatctttttttttttccttctcactatgtacagagaaaaaaaaaaaatagaatcttatttttgtaatacgaggacaaactttatgattgccattttctaattttccaataaatattacgtttgtaaattca

SEQ ID NO: 175693 - DNA, 340 bp, Homo sapiens
  Payload ID: 14509
  Gene Symbol: ARHGAP21
  Gene Name: Rho GTPase activating protein 21
  ENST ID: ENST00000418325
  CDS Start-End: 1-340
tatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactattcctttcagctcatctgaagacagtggcag

SEQ ID NO: 175694 - DNA, 3859 bp, Homo sapiens
  Payload ID: 14509
  Gene Symbol: ARHGAP21
  Gene Name: Rho GTPase activating protein 21
  ENST ID: ENST00000446003
  CDS Start-End: 465-3859
cccggccgggcccggcgcccggccagcgtctccgcttcagctcgccgccgcgcttcggccgccgggcccgagcgggcgggaagggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtgctacagtttacaaaggatgtcacagcactggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgag

SEQ ID NO: 175695 - DNA, 5514 bp, Homo sapiens
  Payload ID: 14509
  Gene Symbol: ARHGAP21
  Gene Name: Rho GTPase activating protein 21
  ENST ID: ENST00000612832
  CDS Start-End: 491-4711
gcgggatcgtccggctgcggggtccggctcacgccgggcgggcgggcggggcgcgctgtcccggagccggccagccccgtgcggatccactcgtcccgcttcctctggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcaattttctagcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcagtaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaattttg

SEQ ID NO: 175696 - DNA, 2751 bp, Homo sapiens
  Payload ID: 14510
  Gene Symbol: ARHGAP22
  Gene Name: Rho GTPase activating protein 22
  Uniprot ID: Q7Z5H3
  ENST ID: ENST00000249601
  CDS Start-End: 298-2394
ggactgccccgccctggtccagtgattgatcagcagtgattactgaggctttaatggtccgcttggatgggaattaattctgggatggataaataatgcatcgaggtttatgtagtccaaggcgagccgtccgtccggagccaggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggcccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagcatg

SEQ ID NO: 175697 - DNA, 2107 bp, Homo sapiens
  Payload ID: 14510
  Gene Symbol: ARHGAP22
  Gene Name: Rho GTPase activating protein 22
  ENST ID: ENST00000374170
  CDS Start-End: 133-1752
cgcgggccggcggtcccgcgcaccctgcgcccagctgggcactgcccgtgggccggacctcggccgcgccgccccggggcgcaggcggcaggcggggagaggagccgagcggcggggccgcgggcggctgccatggggctgtgctgctgcaaggactggaggggacacctgcgagcgcccaaaggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacaggtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagca

SEQ ID NO: 175698 - DNA, 2380 bp, Homo sapiens
  Payload ID: 14510
  Gene Symbol: ARHGAP22
  Gene Name: Rho GTPase activating protein 22
  ENST ID: ENST00000374172
  CDS Start-End: 256-2025
gatgctccaaatatccctacaaagtactttattattcctgtttcacagacaaggaaactggggcacagacaggttgaacaatgttcctgtagctgagccaggatttgaacccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggaggtactgcccgtagatcgcatgcccaccctctagaacccttgcctccagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagca

SEQ ID NO: 175699 - DNA, 2340 bp, Homo sapiens
  Payload ID: 14510
  Gene Symbol: ARHGAP22
  Gene Name: Rho GTPase activating protein 22
  Uniprot ID: Q7Z5H3
  ENST ID: ENST00000417247
  CDS Start-End: 160-1986
aaaaggcctcagcctgatgcccacaggcagagcacacaggcagccgagtggccgcagccctgcagtggaggagtgcctcgtgcacctggtggttttctgcaccccaacaggtgtgtctggccactgctcctctcactgcagcccccgctgctccacaccatgcccttctggcccatcaggtgtctgaagaggagcaggcgtatgcccaggggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagc

SEQ ID NO: 175700 - DNA, 2352 bp, Homo sapiens
  Payload ID: 14510
  Gene Symbol: ARHGAP22
  Gene Name: Rho GTPase activating protein 22
  Uniprot ID: Q7Z5H3
  ENST ID: ENST00000417912
  CDS Start-End: 157-2301
caggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggcccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggaggtactgcccgtagatcgcatgcccaccctctagaacccttgcctccagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttg

SEQ ID NO: 175701 - DNA, 2595 bp, Homo sapiens
  Payload ID: 14510
  Gene Symbol: ARHGAP22
  Gene Name: Rho GTPase activating protein 22
  Uniprot ID: Q7Z5H3
  ENST ID: ENST00000435790
  CDS Start-End: 332-2446
acttctcaattctttgttctgtgaagtggttgtcactattgttcccattttacagatttgaggaactgataccccaagaccccgtgactttctcaaggccattccaagatccctagatgcacttacgcttaatgaactaattcttcacagcgaggcttcttgcttaaaatccaagaaaataccagataaagggcattctaaatatatttcttttctatagatgtggatctcctgttactggaaaacaggaattagcttgtctgcttgaggatgtggttggttctttataaaaaggatacagaagaaatttgcacagactgccagcttcattatgctgccgacagcttccagcaaaaggaggacgtttgcagccagatatttcacccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggac

SEQ ID NO: 175702 - DNA, 2764 bp, Homo sapiens
  Payload ID: 14510
  Gene Symbol: ARHGAP22
  Gene Name: Rho GTPase activating protein 22
  ENST ID: ENST00000460425
  CDS Start-End: 869-1654
agaggcgccgagcagccgggagctccgtcctgcctgaggatgcggggcccaggctgcatccccccggccctgctcgcctgctcatcacacggaggccggggacagggtcacggccagggagcctgcggggctaaaggagcgggccgggagctcaagagctgccgccgggcggcgaggaaggagccccaggcaggccccgggcggccgaggcaggggaggagacggctggccctggttccaggtgagcagccccgcccgctctgctggaggccccgcttaccaccggcgggagatgcgggtgcaagccctggggcgcacgtggccaggccactgccacgcccgagggacgggttttcgtcgccacctcggccctggtgaaccctgtgactggagtgcctcccaatcccaccgtgatgcccacctcggggcgctgccaggtgccaggctaatgcgtgtgatccacagtgtgctgagaagtgctgactgtcattgtgaatgtccgtggtggggtgacgcccgggcagggtgcactggcctggttccagaagacctggcctctccagctcccacggcgcgcccgtttgctgcgtggcccatgctgctggcggctgctcctggctgagtcattccaagacgagcgtccagtccgcgctctctgccgcccttcccagcgctgcccggcaggccccgggaactgtgcccagctgtgcccgcttagctggtgtatgacctgcctttgaacttgctgcaaagaaagatgtggatctcctgttactggaaaacaggaattagcttgtctgcttgaggatgtggttggttctttataaaaaggatacagaagaaatttgcacagactgccagcttcattatgctgccgacagcttccagcaaaaggaggacgtttgcagccagatatttcacccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggacc

SEQ ID NO: 175703 - DNA, 1951 bp, Homo sapiens
  Payload ID: 14510
  Gene Symbol: ARHGAP22
  Gene Name: Rho GTPase activating protein 22
  ENST ID: ENST00000477708
  CDS Start-End: 1-1596
atgtgtgtgcccccacacaggaaagatggctctattccctgtcccagagccctatgctcccagagtgtggacattcaggcatggcagttgtcagcagcacagaggggtgacgtggggcagccgagagagttctggcatctcaggtcccaggttccagttccaacctgccacctgctcaccgtgcagccttggtgcctgcttcctcaccccaccccagctggagggcgtgagcgcaggcacagtgcttcctccctgcttgcggctctgtgcctgaggaaggcggttctgcggccccatcctgctgtcctgcctggagttggagggtgtgtggtcctttcctctgggcggatgaaggctcccttgaggggcggcctggctctggggacagggccagctcccacgaagctgcagcttctccatgactggcagagcgagcctgggccgagtggctggcagcaaggcccttctccgcctctcttcccggcaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagca

SEQ ID NO: 175704 - DNA, 407 bp, Homo sapiens
  Payload ID: 14511
  Gene Symbol: ARHGAP23
  Gene Name: Rho GTPase activating protein 23
  ENST ID: ENST00000620329
  CDS Start-End: 1-407
atccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagc

SEQ ID NO: 175705 - DNA, 5964 bp, Homo sapiens
  Payload ID: 14511
  Gene Symbol: ARHGAP23
  Gene Name: Rho GTPase activating protein 23
  Uniprot ID: Q9P227
  ENST ID: ENST00000610551
  CDS Start-End: 69-4544
ccgcccctcccgggtccctgccggcgcccccagccgtgccccggccgcagagccgccgctgccacccgatgaatggagtcgccttctgcctggtcgggatcccgccccgcccggagccccggcccccacagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccaccgccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcacgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggctactccaccctgtccaccatggaccgcagcgtgtgctcgggcgctagcggtcggcgggcaggggcgggggatgaggcggacgacgagcgtagcgagctgagccacgtggagacggacactgagggcgcggcgggcgcggggcctggggggcgcctgacacgccggccgtccttcagctcgcaccacctcatgccctgcgacactctggcgcgccgccgcctggcccggggccgcccagacggcgagggcgcgggccggggcggtccccgcgccccggagccgcccggctcggcgtcgtccagcagccaggagtcgctgcggcccccggcggcggcgctggcctcccggccctcgcgcatggaggcgctgcgtctaaggctccgcggcacggcggacgacatgctcgccgtgcgcctgcggcggccgctgtcgcccgagacccggcggcgccggagcagctggcgccgccacaccgtggtggtgcagagcccgctgactgacctcaacttcaacgagtggaaggagctgggcggagggggccccccggagcctgcgggcgcgcgggcgcacagtgacaacaaggactccggactcagcagcctggagtccaccaaggcgcgggccccgtcgtccgctgcctcgcagccgcccgcgcccggggacacggggtccctgcagagccagcccccgcgccgctcggccgcctcccgcctgcatcagtgtctgtgatccccacctcccgcgccgctcgggcgccacccctccctagagcccctttggaaccaggaggcttcaccagcctgcacctcctcttctgtggcccctgggtgcatggtgtgggtggagggcgcagcaggcagtgtctctagttggtgtgctggaactggcagggcagaggagaaggctggggccggactaattgaatggaagggggttccagaggtgatgagcagaagaggagggggcgtgggctgctggggtctgtgtccctgcacacatgcgcccgataggtccttctgagcctttctgtggctgcacttggggacccttgtggaccatggggtgtggctagggaacccctaagtttcagactaaaggaaagatcctgggtgatgctggctttttgcttctttcttctgccctcccacctcagcttgtaagcggggatgtgtgtatgtctggggagaggaggtgtagggtgcgtatgtccatggggggaggggcttgtgtgtgcagtcattgtcccaaggtgtttccagtagcgacttctgtccccctatccccaccctggtccccactttgcgcccccgggctccctgcctttggtgcacacaggatcctgcccgccccccttgccagagccagagaagggggttggggccattccaaggaggcaggactgaaaccctcaccagggttactccccaacatccttttgcctgagtcaccctctaagcgctttaaccacgggcagctgcctgttccccagacagtttttggtggggggggtccagggtcccccttgctggtacctccctcacccctctttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcatga

SEQ ID NO: 175706 - DNA, 488 bp, Homo sapiens
  Payload ID: 14511
  Gene Symbol: ARHGAP23
  Gene Name: Rho GTPase activating protein 23
  ENST ID: ENST00000616909
  CDS Start-End: 1-488
cgaccttcagcgatatcaggagagaaggctggttgtattataagcagattctcaccaagaaggggaaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcatt

SEQ ID NO: 175707 - DNA, 5964 bp, Homo sapiens
  Payload ID: 14511
  Gene Symbol: ARHGAP23
  Gene Name: Rho GTPase activating protein 23
  Uniprot ID: Q9P227
  ENST ID: ENST00000622683
  CDS Start-End: 69-4544
ccgcccctcccgggtccctgccggcgcccccagccgtgccccggccgcagagccgccgctgccacccgatgaatggagtcgccttctgcctggtcgggatcccgccccgcccggagccccggcccccacagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccacccccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggctactccaccctgtccaccatggaccgcagcgtgtgctcgggcgctagcggtcggcgggcaggggcgggggatgaggcggacgacgagcgtagcgagctgagccacgtggagacggacactgagggcgcggcgggcgcggggcctggggggcgcctgacacgccggccgtccttcagctcgcaccacctcatgccctgcgacactctggcgcgccgccgcctggcccggggccgcccagacggcgagggcgcgggccggggcggtccccgcgccccggagccgcccggctcggcgtcgtccagcagccaggagtcgctgcggcccccggcggcggcgctggcctcccggccctcgcgcatggaggcgctgcgtctaaggctccgcggcacggcggacgacatgctcgccgtgcgcctgcggcggccgctgtcgcccgagacccggcggcgccggagcagctggcgccgccacaccgtggtggtgcagagcccgctgactgacctcaacttcaacgagtggaaggagctgggcggagggggccccccggagcctgcgggcgcgcgggcgcacagtgacaacaaggactccggactcagcagcctggagtccaccaaggcgcgggccccgtcgtccgctgcctcgcagccgcccgcgcccggggacacggggtccctgcagagccagcccccgcgccgctcggccgcctcccgcctgcatcagtgtctgtgatccccacctcccgcgccgctcgggcgccacccctccctagagcccctttggaaccaggaggcttcaccagcctgcacctcctcttctgtggcccctgggtgcatggtgtgggtggagggcgcagcaggcagtgtctctagttggtgtgctggaactggcagggcagaggagaaggctggggccggactaattgaatggaagggggttccagaggtgatgagcagaagaggagggggcgtgggctgctggggtctgtgtccctgcacacatgcgcccgataggtccttctgagcctttctgtggctgcacttggggacccttgtggaccatggggtgtggctagggaacccctaagtttcagactaaaggaaagatcctgggtgatgctggctttttgcttctttcttctgccctcccacctcagcttgtaagcggggatgtgtgtatgtctggggagaggaggtgtagggtgcgtatgtccatggggggaggggcttgtgtgtgcagtcattgtcccaaggtgtttccagtagcgacttctgtccccctatccccaccctggtccccactttgcgcccccgggctccctgcctttggtgcacacaggatcctgcccgccccccttgccagagccagagaagggggttggggccattccaaggaggcaggactgaaaccctcaccagggttactccccaacatccttttgcctgagtcaccctctaagcgctttaaccacgggcagctgcctgttccccagacagtttttggtggggggggtccagggtcccccttgctggtacctccctcacccctctttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcatga

SEQ ID NO: 175708 - DNA, 438 bp, Homo sapiens
  Payload ID: 14511
  Gene Symbol: ARHGAP23
  Gene Name: Rho GTPase activating protein 23
  ENST ID: ENST00000620325
  CDS Start-End: 1-252
cgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatggtgcccttctcttctgacctgctgaaccttggtgtccatgtcctggagacgggggcagggaccccttttctgggatcagcatgcagctcagatggtattgcctcccaaatgaacacagctgggctaccccaggtcaggtgcacacccgagtgtagctgtgacaaatacaacgacttcatcgaggccaaccgcattgaggacgc

SEQ ID NO: 175709 - DNA, 969 bp, Homo sapiens
  Payload ID: 14511
  Gene Symbol: ARHGAP23
  Gene Name: Rho GTPase activating protein 23
  ENST ID: ENST00000618942
  CDS Start-End: 663-969
gaaggatgcgtgtgtgccggtctgctgtgcatgtgtgtatctgcatgtctgtgatgcatgcgcatgcgtctgtatgtgcattgtgtgtgcaggactttgattctgtgcaactctgtgcatatctatgtgtctacaaaagtgtgcacatgtgtactcatttgtgtgtgtgtatctgtgtgtctgcatatttgcacatgcttgtctgtatgtttgtggtatgttccgtctacatgagtgtatgtggctggggctgtgtctgcataagtatgtgtctatctgggagtgcatatatgtgtgcatgtgtgtgtgtgagattgtgcatgagctaagacaacgacaggcacttcctgggcaggaaggctgtatccagggtcctgcacatagtaggtgctcagtgaacatttgctgaactcagctgaactgaactgaatgaacttgcttcactgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccacccccgatctgctacccccgcaagacctacgccc

SEQ ID NO: 175710 - DNA, 3663 bp, Homo sapiens
  Payload ID: 14511
  Gene Symbol: ARHGAP23
  Gene Name: Rho GTPase activating protein 23
  Uniprot ID: Q9P227
  ENST ID: ENST00000620417
  CDS Start-End: 1-3435
atgaatggagtcgccttctgcctggtcgggatcccgccccgcccggagccccggcccccacagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccacccccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagcggacctgttggagatttaaaggattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgc

SEQ ID NO: 175711 - DNA, 769 bp, Homo sapiens
  Payload ID: 14511
  Gene Symbol: ARHGAP23
  Gene Name: Rho GTPase activating protein 23
  ENST ID: ENST00000619156
  CDS Start-End: 1-390
tccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccag

SEQ ID NO: 175712 - DNA, 659 bp, Homo sapiens
  Payload ID: 14511
  Gene Symbol: ARHGAP23
  Gene Name: Rho GTPase activating protein 23
  ENST ID: ENST00000614693
  CDS Start-End: 1-193
gttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaaggtacgtatgaaggcaattctgaaggcttgatccctgtacaaggcagcccactttggtttttgttcaagggaattgagggaatggcagttggaccatggggaaagttgatggtccctgggagggaaggcaggaggtaccgagtgcccaaggtaagctgagaaattgcttaccttggcagtgtttggtgaggcatctgctgtagtagaaggacctggcctgggagttatgtggctaggaggcaatgtcactcagtagttagaagcacagactctgcagtcagacagtcctgggtttgagttctggctccaccatttagtagtttgggacattgggcaagttacttaaccactttctgatccttagcttcctcatctataaaatgggaatatcagtaaatctgtggggtgctataataaataaaacagatatcctttaaggtctttggagagcctaaagcaagcagaaggaaataaagagaggagcagaaatccatgaa

SEQ ID NO: 175713 - DNA, 769 bp, Homo sapiens; identical to SEQ ID NO: 175711
  Payload ID: 14511
  Gene Symbol: ARHGAP23
  Gene Name: Rho GTPase activating protein 23
  ENST ID: ENST00000633443
  CDS Start-End: 1-390

SEQ ID NO: 175714 - DNA, 659 bp, Homo sapiens; identical to SEQ ID NO: 175712
  Payload ID: 14511
  Gene Symbol: ARHGAP23
  Gene Name: Rho GTPase activating protein 23
  ENST ID: ENST00000634129
  CDS Start-End: 1-193

SEQ ID NO: 175715 - DNA, 407 bp, Homo sapiens; identical to SEQ ID NO: 175704
  Payload ID: 14511
  Gene Symbol: ARHGAP23
  Gene Name: Rho GTPase activating protein 23
  ENST ID: ENST00000631490
  CDS Start-End: 1-407

SEQ ID NO: 175716 - DNA, 3663 bp, Homo sapiens
  Payload ID: 14511
  Gene Symbol: ARHGAP23
  Gene Name: Rho GTPase activating protein 23
  Uniprot ID: Q9P227
  ENST ID: ENST00000631799
  CDS Start-End: 1-3435
atgaatggagtcgccttctgcctggtcgggatcccgccccgcccggagccccggcccccacagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccaccgccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcacgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagcggacctgttggagatttaaaggattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgc

SEQ ID NO: 175717 - DNA, 438 bp, Homo sapiens; identical to SEQ ID NO: 175708
  Payload ID: 14511
  Gene Symbol: ARHGAP23
  Gene Name: Rho GTPase activating protein 23
  ENST ID: ENST00000632895
  CDS Start-End: 1-252

SEQ ID NO: 175718 - DNA, 488 bp, Homo sapiens; identical to SEQ ID NO: 175706
  Payload ID: 14511
  Gene Symbol: ARHGAP23
  Gene Name: Rho GTPase activating protein 23
  ENST ID: ENST00000633302
  CDS Start-End: 1-488

SEQ ID NO: 175719 - DNA, 969 bp, Homo sapiens
  Payload ID: 14511
  Gene Symbol: ARHGAP23
  Gene Name: Rho GTPase activating protein 23
  ENST ID: ENST00000632947
  CDS Start-End: 663-969
gaaggatgcgtgtgtgccggtctgctgtgcatgtgtgtatctgcatgtctgtgatgcatgcgcatgcgtctgtatgtgcattgtgtgtgcaggactttgattctgtgcaactctgtgcatatctatgtgtctacaaaagtgtgcacatgtgtactcatttgtgtgtgtgtatctgtgtgtctgcatatttgcacatgcttgtctgtatgtttgtggtatgttccgtctacatgagtgtatgtggctggggctgtgtctgcataagtatgtgtctatctgggagtgcatatatgtgtgcatgtgtgtgtgtgagattgtgcatgagctaagacaacgacaggcacttcctgggcaggaaggctgtatccagggtcctgcacatagtaggtgctcagtgaacatttgctgaactcagctgaactgaactgaatgaacttgcttcactgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccaccgccgatctgctacccccgcaagacctacgccc

SEQ ID NO: 175720 - DNA, 4572 bp, Homo sapiens
  Payload ID: 14512
  Gene Symbol: ARHGAP24
  Gene Name: Rho GTPase activating protein 24
  Uniprot ID: Q8N264
  ENST ID: ENST00000264343
  CDS Start-End: 659-2626
gggagtttgaagacagaaaggaaaggggagaaacctgcagagagcatcaaaggatggggggtgctataaaagaagcaggggggtcctttgaaagaaatctatcatgcactgaaatgctttctggagaaggtgccattattttcctcccctcttgctcagatgaaaggagccagcaaggacagtcctgaaatattcctcaggggactttttgtcattgttcctctttcctcttgcacagagctatttgctgacctttccagaggaatctcagtccagctgagaagacagttcttaataaaaacaaaaaaatgcaaaaaccaattcctgctgtttgaatgggaatggtagcttgcttgctgcagttcttttcctgtgacattttggaatgtctgcagaaacttaaaaaaaagaaaaaaaaaaccttaaaaactccctggattaggcaagagaaaaggaagtttttttttgctaaacaggagtaaatgagaggtggtaacttatccctaagccaggacctggatgatcaaaaccttcaaattctagggatcagcacttcaaaaataacaagtaaacaagcatgaggagtggctgttgggtttcgctcagaggcaggttttaaaggaagccaaaaccgggttcagaacttcaggcctgtacgatgcctgaagaccggaattctggggggtgcccggctggtgccttagcctcaactcctttcatccctaaaactacatacagaagaatcaaacggtgttttagttttcggaaaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccata

SEQ ID NO: 175721 - DNA, 2740 bp, Homo sapiens
  Payload ID: 14512
  Gene Symbol: ARHGAP24
  Gene Name: Rho GTPase activating protein 24
  Uniprot ID: Q8N264
  ENST ID: ENST00000395183
  CDS Start-End: 278-2239
ggatgggaggatactgactaagtctgagaaggaggagaaagaaaattagctacaggaagagtttatatccccttctacaagaaaacttaaatatagctaccaccgctttgaaaggaatggtttgtgtccaaacagcattttccagacaagctctgtacttttttgccaaaagaattaactttaaactgaaggcagtggacagttaaacaagagtcggcactgggaacagctgtgcgtagaccagaccagtgacttataaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaata

SEQ ID NO: 175722 - DNA, 4661 bp, Homo sapiens
  Payload ID: 14512
  Gene Symbol: ARHGAP24
  Gene Name: Rho GTPase activating protein 24
  Uniprot ID: Q8N264
  ENST ID: ENST00000395184
  CDS Start-End: 467-2713
ttgtactgtatatttacacattcacacacaatcaccctttctaacttctgggactctttgcgcaactgctaggatttctcaagtgcatgtggcaacacagcccagctccgggtggaaaccagcagggctctggaggggctcggagaccaggggagctgtcaaggctgcggcggggaccagagaggagcctggcgggggtggctgggtggctgggggaatccccccaacttcccatcgcaggcgcagctctctcggccgcctatttcctccgaaacccgcgctgcggagcagcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccataga

SEQ ID NO: 175723 - DNA, 1273 bp, Homo sapiens
  Payload ID: 14512
  Gene Symbol: ARHGAP24
  Gene Name: Rho GTPase activating protein 24
  Uniprot ID: Q8N264
  ENST ID: ENST00000503995
  CDS Start-End: 343-1083
gggctctggaggggctcggagaccaggggagctgtcaaggctgcggcggggaccagagaggagcctggcgggggtggctgggtggctgggggaatccccccaacttcccatcgcaggcgcagctctctcggccgcctatttcctccgaaacccgcgctgcggagcagcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcagtaagttgatgcatttatttccaaataagcttttgtttggaatttttttctgtgttcttagtcttaaatctgtaaatttccattgccctatcccggtgttactctccactatcctttgaattgacctcacacacactgagactttccgtatacagctcaagcaccatttccgatcccctctctgatcaaaaaaaaagaa

SEQ ID NO: 175724 - DNA, 572 bp, Homo sapiens
  Payload ID: 14512
  Gene Symbol: ARHGAP24
  Gene Name: Rho GTPase activating protein 24
  ENST ID: ENST00000509300
  CDS Start-End: 219-572
tttttacctgagctcagtagctggggagcccactagtgctggggagcgagccgtggtttccattcctgggtgatggagtcatgggagaaactgcagtgagcaaacacagtaggacctgagttgggctcgaatgtgctttaagcgactcaggacagagcagctgctctgtctcccagcttgcaagtgcagcctgcatttgtcactgaccactgaagtgtatgtttgtgcaaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagca

SEQ ID NO: 175725 - DNA, 1936 bp, Homo sapiens
  Payload ID: 14512
  Gene Symbol: ARHGAP24
  Gene Name: Rho GTPase activating protein 24
  ENST ID: ENST00000514229
  CDS Start-End: 71-1936
aggacagagcagctgctctgtctcccagcttgcaagtgcagcctgcatttgtcactgaccactgaagtgtatgtttgtgcaaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagca

SEQ ID NO: 175726 - DNA, 567 bp, Homo sapiens
  Payload ID: 14512
  Gene Symbol: ARHGAP24
  Gene Name: Rho GTPase activating protein 24
  ENST ID: ENST00000512201
  CDS Start-End: 322-567
ataactcattaggcttgaatgagatgctttgaactgtggtgactacagtaatgttcccctctgcatgttgaagtgacaagtgcctccttggcctattgctgatcctgcctgctgtagaaatctccagctgtccaatatttggaagaaaactggctgtgcgtgtagtagagatgctctctctttgtgaagaaggccctgcatacattaaacaagtccggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgcca

SEQ ID NO: 175727 - DNA, 2939 bp, Homo sapiens
  Payload ID: 14513
  Gene Symbol: ARHGAP25
  Gene Name: Rho GTPase activating protein 25
  Uniprot ID: P42331
  ENST ID: ENST00000409220
  CDS Start-End: 381-2300
ccgagccttcagagtgaggcattattttctcctctctcttgtcagatactgactcccacgcaggaaaaaggaagcaccttttgtcagatgctgtggccacttcctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 175728 - DNA, 2936 bp, Homo sapiens
  Payload ID: 14513
  Gene Symbol: ARHGAP25
  Gene Name: Rho GTPase activating protein 25
  Uniprot ID: P42331
  ENST ID: ENST00000409030
  CDS Start-End: 381-2297
ccgagccttcagagtgaggcattattttctcctctctcttgtcagatactgactcccacgcaggaaaaaggaagcaccttttgtcagatgctgtggccacttcctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 175729 - DNA, 2945 bp, Homo sapiens
  Payload ID: 14513
  Gene Symbol: ARHGAP25
  Gene Name: Rho GTPase activating protein 25
  Uniprot ID: P42331
  ENST ID: ENST00000409202
  CDS Start-End: 366-2306
agtaaggcctgagattctttcgaaaaggagctttgcttcccatgacgcagagggaagtgtcaactgggatatttctggtaaaactgaaagcaagaaaagcagggtgctagcccctgtgggactgagggtggaggctgggggagtttgggtgccatcctccagtgacagatggatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 175730 - DNA, 1843 bp, Homo sapiens
  Payload ID: 14513
  Gene Symbol: ARHGAP25
  Gene Name: Rho GTPase activating protein 25
  Uniprot ID: P42331
  ENST ID: ENST00000497079
  CDS Start-End: 242-1618
gaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatggtaaggtgcagagaaccttcctgcttccattgggttcttcctttagtccaggccatcccatgtaaggcctgctctcgggtggcaatttggggagttttaggtgatgcagtggcagtgggcgctgctgctacagactcatctgaacacaccttgaaagcctggcctctttccaaatctagtttctattggcatctttgaggggggtgagtgacaagtgtgccaatcacccagtgactgagcaatgaggtcctcactgaagcccactctgaaagagagactcaaatacagtccagagaagttcagtgggaaaaatgtatacaacattgtaaatgttttggtcagaattgttgaaaattctgggtgaacgtccagagaaaactggtttcctgctaacccatgaaacgtgattcctttctcagagta

SEQ ID NO: 175731 - DNA, 1227 bp, Homo sapiens
  Payload ID: 14513
  Gene Symbol: ARHGAP25
  Gene Name: Rho GTPase activating protein 25
  ENST ID: ENST00000463483
  CDS Start-End: 341-1192
gtttacctaagctagcctgggcaatggcgggcgcccctcccccagcttctctgcggccttgcagtttgatctcagactgctgtgctagcaatcagcgagactccgcgggcgtaggaccctccgagccagagtctcctgcaatgattcagacttggctttactggcttcttccatagataagcaccagcctaggagctctcaaagttgttccagctaaaggacacactcagcttttggtctacagtgacttccagcctaagtggctctggacactgctggaaccccccgctccatctccctccataaatatgtctctgcagcagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaagaactacaggaacaggaatgactgccaaagtgttgtttctgcacagatacaccaattctgtcccagggtctccttgctggcacatgggcaggctcatttactggtaaatgatttacttgtgtaaatctcttcccaggctcagcaggagttgatgaagca

SEQ ID NO: 175732 - DNA, 1362 bp, Homo sapiens
  Payload ID: 14513
  Gene Symbol: ARHGAP25
  Gene Name: Rho GTPase activating protein 25
  ENST ID: ENST00000473986
  CDS Start-End: 278-535
ctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagagtggtcctccaggaagcaccaggacgggcactgtggagtttcctacacatggctctgagtcaagactggcaacagggcggtgatggtagtgacactcagtcaagggctcagagagagtggatttgggttcaggaaaaccgattttgggactcattgatttgtttgttcaggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagg

SEQ ID NO: 175733 - DNA, 1933 bp, Homo sapiens
  Payload ID: 14513
  Gene Symbol: ARHGAP25
  Gene Name: Rho GTPase activating protein 25
  ENST ID: ENST00000479844
  CDS Start-End: 275-1294
attctgggccaccctggttattttccttcagccctttctggggacctgctgtgcgccacccctgtggcaactctagctgtggattgacccagatctggctcggctgggaactgggatcttcatcccagactgacctgaattttgtcttttattttttaaaaataatttgttgtagttcctagattataaaagtcatgcttgcttgacttggaaaccaggaagatatagcaaacagttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 175734 - DNA, 2096 bp, Homo sapiens
  Payload ID: 14513
  Gene Symbol: ARHGAP25
  Gene Name: Rho GTPase activating protein 25
  ENST ID: ENST00000497259
  CDS Start-End: 1-1517
aagcacagaatgacgggcaggttctgtttgctctctcctcagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtat

SEQ ID NO: 175735 - DNA, 990 bp, Homo sapiens
  Payload ID: 14513
  Gene Symbol: ARHGAP25
  Gene Name: Rho GTPase activating protein 25
  ENST ID: ENST00000488795
  CDS Start-End: 125-544
gaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggtgagaggcccctggtatcaactctgcagttttcaaccccatcagaaagaagctcctagttagaagaggagggaccacgtctgtgaacagagagattctggtctagcactttggaagatcagctgtattcacatagcactgaagtagcttcctgtataatttcaaggattctgaaaacctggttgaacca

SEQ ID NO: 175736 - DNA, 2247 bp, Homo sapiens
  Payload ID: 14513
  Gene Symbol: ARHGAP25
  Gene Name: Rho GTPase activating protein 25
  Uniprot ID: P42331
  ENST ID: ENST00000467265
  CDS Start-End: 319-2139
cagagggaagtgtcaactgggatatttctggtaaaactgaaagcaagaaaagcagggtgctagcccctgtgggactgagggtggaggctgggggagtttgggtgccatcctccagtgacagatggatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaagga

SEQ ID NO: 175737 - DNA, 6862 bp, Homo sapiens
  Payload ID: 14514
  Gene Symbol: ARHGAP26
  Gene Name: Rho GTPase activating protein 26
  Uniprot ID: Q9UNA1
  ENST ID: ENST00000274498
  CDS Start-End: 379-2823
ggcggggcggccgaggctgctgtgagagggcgctcgaggctgccgagagctagctagcgaaggaggcggggaggcggcgtctgcactcgctcgcccgctcgctcgcttcccggcgccgctgcgggtccgcgctgcgtttcctgctcgcgatccgctccgttgcccgcgcccggaacagcagcacctcggccgggtccgagctcggttcgggagtcttgcgcgccggcggacaccgcgcgcggagtgagccagcgccacacctgtggagccggcggccgtcgggggagccggccggggtcccgccgcgtgagtgctctgggcggcgggcggcccgggccccggcggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttaacaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcaatcttggctcactgcaacctccacctcccaggttcaagtgattctcctgtctcagcctcccaagtagctgggactacaggcatgagccatcacacccagctagttttttgtatttttagtaaagatggggttttgccatgtttgccaggctgatctcgaactcctgacctcaagtgatctgcccacttcagacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacatttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggcagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaagg

SEQ ID NO: 175738 - DNA, 9200 bp, Homo sapiens
  Payload ID: 14514
  Gene Symbol: ARHGAP26
  Gene Name: Rho GTPase activating protein 26
  Uniprot ID: Q9UNA1
  ENST ID: ENST00000378004
  CDS Start-End: 356-2635
gagagggcgctcgaggctgccgagagctagctagcgaaggaggcggggaggcggcgtctgcactcgctcgcccgctcgctcgcttcccggcgccgctgcgggtccgcgctgcgtttcctgctcgcgatccgctccgttgcccgcgcccggaacagcagcacctcggccgggtccgagctcggttcgggagtcttgcgcgccggcggacaccgcgcgcggagtgagccagcgccacacctgtggagccggcggccgtcgggggagccggccggggtcccgccgcgtgagtgctctgggcggcgggcggcccgggccccggcggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttaacaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcaatcttggctcactgcaacctccacctcccaggttcaagtgattctcctgtctcagcctcccaagtagctgggactacaggcatgagccatcacacccagctagttttttgtatttttagtaaagatggggttttgccatgtttgccaggctgatctcgaactcctgacctcaagtgatctgcccacttcagacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacatttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggcagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaaggaaaaaaaaaaaaaaaaaaaaagaatgccatgccaggagaagacagctggtttcaaatccctgcccccaggcaagtaaaaccctgacttgctcaagacagaagatcttttctcctgtttttcaaaataaacatatatagggatggaccctgtgcattgtggcctgccttggtgtcctagaattggagccagtctttagcttaatgtctgaagtatttatacggccaatatgtgttttcttatgtcagaccacactgtctttttgaatatcagttcatttcctctcaccgagtgcttttcggtgagaggcaaagagaaagaatgaacaatcaagtattgacagactggcattagcaggacagagccatactagtgacaagggcatcccaaggcacttgcccagagctgcagagttgtgtgtgccatacctgcggctcaaagggaaggccttctatcccctgagtttctatcagctgaaaatggcaactgctgtctcagtaaaagctctgtcttgactgcagaggctccaaaagcattcacagttgagggggagaaagacagaaagaagaagccaaagataacctgatccctgcctgtctgttggcacctgtcatcctctggcttctgctcccaaaagcaagtctggatgactgagttttgtggacatggcactcccggagacagcagtggccaccatggcacccagagtttgcccaagtactgaatgttttgtgagcaaccatgttccccaagtaggtagccagcgctgcagaaaccaaacagcctcttagctacctgactttaaaaggaatgacctaggtgttctgccaaaggagttatctatcatctctggcaaacttgacaatcatcacttacctcgacaaccctgccccacatcactttataaagtcagcaggatgtcttctcacccaccctgtgctggtgtctaacaaatttatcttgtcatgctcaaatgtgtttggcagccacaccgatcggctgggtgctgaaccgcctctctgtaattgtagcatcaaaatgacaacagcagcagagcagcgaatcttgcacagccccacagcatgcctgagacaagactccaacaagtaataattagctttttttctcctgccgcctacagtacctgtctaactaaagagcttcccaaagtggagggaaaggccatagaatccaggtgtcattcagagccagtccttgctgaaatgtggtcttccagtggaagcacctgtattattgagaggaaaaagtgttggatgcaaagtaacaccaggactagagagaaagagaaaggtgaaccatcctaaggagctttggatacttttttagaaggataaatattatgcttactgaggagaaaaaaaaaagcgatcacagaaaaatttcacagctaatatttttacaaaagttgtgccagacattacagagtgaaaacgtctctcaaggtggaatgctttagagagcaaaggcttagcatagacctagacccttgtgtgggtatgacatgacatgacatgtccatgtcaaaattcactttagtcagaaccagagtattgataaacaaaatgtcagttacctggagcagtcctggagaggttaagacattctatactgttctacgtcaaccatttctacaaagttgtccagacacctaaaagcagctttcttggttatccagatgccagaatcaaccttgtatctgacaatgcacatctgttgattctaaagtatatttatgtgtgtgtgtatgtgtgtgtatacagcacatatttacatctatgaagacatagacacttacagagacccacatgagctggcactttctgagcctttacagcctttaagactcggaggttgagaattagagacacaagagaggctgtggatggcctattaaaatgattaaagatgtaaattcagtgccattttaaaactgttcatatttatcaaacaattactgtctacagctacattttttgttaacttacttaaagtcatgtcgcaagaaagatcaaacccatgaatgcttagtagctaaggctagtgttcaaaagcactctaaaagacattttgtccacattttggaaaagaaaatatttgcatgtttaattcataatttaggctatctttgagtatactgtaaagtgctgtgtgatataatatcaataaagtacttattaaatggcactttaatgttttcttttaaaataacgcactgttctaaacttcagtattgactattgactcgtgcatagaatccaatgctgtaattagaaagtaatctgtgactagaatagacctttgtccctgttagtagccctgttgccatgttcaggcttttaaaaaatgcttttgtgtcaccaaatatatctataaagaaaacaaaatttctgttcagaggcctctgaaacttggctttcttacatgtggttggtttatgtgacaatccctatgaaatgagtggacgtatgatttttgaattaaatgacttttccatttggtggtatttt

SEQ ID NO: 175739 - DNA, 564 bp, Homo sapiens
  Payload ID: 14514
  Gene Symbol: ARHGAP26
  Gene Name: Rho GTPase activating protein 26
  ENST ID: ENST00000378013
  CDS Start-End: 65-564
agccagagatggagtccctgccagtgcagagctcttgacttctgccccatctcacttgcccggaatggaacctcttgcaccaagccctagaatttggacttgtgttttctattttggcattgaatctgaggaggatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttga

SEQ ID NO: 175740 - DNA, 783 bp, Homo sapiens
  Payload ID: 14514
  Gene Symbol: ARHGAP26
  Gene Name: Rho GTPase activating protein 26
  ENST ID: ENST00000421521
  CDS Start-End: 1-463
ccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataacgcagagtgtccttcagcttccacagccatcttcactgccacaccgaagctccgggcacctccacctctcacctgggcacttccactggccgcctgacacatcttctcacatctgctcttgctgccataaccccctctttacagagcagcgagagtgatctttgaaaaacggaaatggcattaaagcccttcagtggcctcccattgctctgagaattacttacaaggccctccagggcccagttcctgcccctctgacctcacgccctcacttgacatactacagcctcatgccttcttcatgttctcaagcaaggtcggcaaactatgacctgcccgtcaaatccaacctgccacctgtcacctaacaattctgtaactgctcccacatacaacatggtcgtcatcataaatcct

SEQ ID NO: 175741 - DNA, 412 bp, Homo sapiens
  Payload ID: 14514
  Gene Symbol: ARHGAP26
  Gene Name: Rho GTPase activating protein 26
  ENST ID: ENST00000443045
  CDS Start-End: 1-294
gcaaaactggagaaccaggagtctcgggtctctgaaatccacagccttgttcatcggctcccagagaaaaatcggcagatgttacagctgctcatgaaccacttggcaaagtatgctggaggcttaggaaagaaatgtgtgaaatgttcattgcagtggagaacagcagcaaatgccagatggccttcccagaggatgctggggaagtgctcatgcaaccaggccaccaagcagagttttcagggggattttacctatggtgatcaagggcaaattggagtgtgttgtccatgataccaggtcaccacacagaattttgtgggattatatgttcttatgctcatcaagaacaaacaaaaatatgttgtgggtttacagaatttgggtttttagtaaagaggactggattcta

SEQ ID NO: 175742 - DNA, 2870 bp, Homo sapiens
  Payload ID: 14514
  Gene Symbol: ARHGAP26
  Gene Name: Rho GTPase activating protein 26
  ENST ID: ENST00000443674
  CDS Start-End: 1-1166
ctgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggccagaagaagcggtacatgaagactccagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttg

SEQ ID NO: 175743 - DNA, 559 bp, Homo sapiens
  Payload ID: 14514
  Gene Symbol: ARHGAP26
  Gene Name: Rho GTPase activating protein 26
  ENST ID: ENST00000424007
  CDS Start-End: 1-384
gtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactgcactggggatttggaatgtgtttggagggttgtactgaggtgcagagtcctgcttcgtgatgggcacaagggttcatgcgagttcagcaagcagttaccatgtctacggcatgccaggatactgttgggaaggtagtattccgttgttcagcctcctcgtcaactttgttccctgccatccaaacctgcacttgctttttgacaggccagaagaagcggtacatgaagactccag

SEQ ID NO: 175744 - DNA, 785 bp, Homo sapiens
  Payload ID: 14514
  Gene Symbol: ARHGAP26
  Gene Name: Rho GTPase activating protein 26
  ENST ID: ENST00000425417
  CDS Start-End: 1-296
ccccgaatccaagcccaacttcacccctctcgccatcttggcccatgttctcggcgccatccagccctatgcccacctcatccacgtccagcgactcatcccccgtcagcacaccgttccggaaggcaaaagccttgtatgcctgcaaagctgaacatgactcagaactttcgttcacagcaggcacggtcttcgataacgcagagtgtccttcagcttccacagccatcttcactgccacaccgaagctccgggcacctccacctctcacctgggcacttccactggccgcctgacacatcttctcacatctgctcttgctgccataaccccctctttacagagcagcgagagtgatctttgaaaaacggaaatggcattaaagcccttcagtggcctcccattgctctgagaattacttacaaggccctccagggcccagttcctgcccctctgacctcacgccctcacttgacatactacagcctcatgccttcttcatgttctcaagcaaggtcggcaaactatgacctgcccgtcaaatccaacctgccacctgtcacctaacaattctgtaactgctcccacatacaacatggtcgtcatcataaatcctataggtattgttgagagcaggaggaaagtttggttgagtgagtgagagaccttacccaagccttcctgtggtctctaggagtcatggcagagttcgctgacactggtctgcttttaaccagccttgccagtgacctttcaaattccctgaggagcaaaaggccaaattg

SEQ ID NO: 175745 - DNA, 527 bp, Homo sapiens
  Payload ID: 14514
  Gene Symbol: ARHGAP26
  Gene Name: Rho GTPase activating protein 26
  ENST ID: ENST00000451259
  CDS Start-End: 253-527
tttctgcgttctctcctcaatcatcttactcctgtcagtgaagagagtggaaacttcagttggggcttgatgatgggaacggggattagtttccccagggaacctttacttccgttgtattttaagacccactggatgtagcatcaatgggaaacagtcttctttggtccctgggggaaatcccggggtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcag

SEQ ID NO: 175746 - DNA, 565 bp, Homo sapiens
  Payload ID: 14514
  Gene Symbol: ARHGAP26
  Gene Name: Rho GTPase activating protein 26
  ENST ID: ENST00000419676
  CDS Start-End: 1-384
attgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcacttgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggc

SEQ ID NO: 175747 - DNA, 1632 bp, Homo sapiens
  Payload ID: 14514
  Gene Symbol: ARHGAP26
  Gene Name: Rho GTPase activating protein 26
  ENST ID: ENST00000418236
  CDS Start-End: 1-884
accccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaa

SEQ ID NO: 175748 - DNA, 1376 bp, Homo sapiens
  Payload ID: 14515
  Gene Symbol: ARHGAP27
  Gene Name: Rho GTPase activating protein 27
  Uniprot ID: Q6ZUM4
  ENST ID: ENST00000290470
  CDS Start-End: 450-1241
ggaagttctgcccggcgctctccgccggtgcctccctggttatattgttgaacaggaaacccggcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtacctccccgggcgctggggcgcggaggcgggtggcgcgctagggaccgcgcccgcacggagccggggcgcaaggagacccgctccgctcagcgtcgggcacgacgcccacctctgtccgaagacttcggatgagctccctctccccaaccgcgaaacgtgaggggtgcacgcccgcagtccctcatcagcaattcccaagctccaaagctccctggaagcccagaggcttttcgtaatccaattggtggcaaaattgcgcttgaactg

SEQ ID NO: 175749 - DNA, 3628 bp, Homo sapiens
  Payload ID: 14515
  Gene Symbol: ARHGAP27
  Gene Name: Rho GTPase activating protein 27
  Uniprot ID: Q6ZUM4
  ENST ID: ENST00000376922
  CDS Start-End: 435-2081
acatgagcaggcagccccgactggaaggagcccggggccctcattccttctcctccactgggaactgagtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcct

SEQ ID NO: 175750 - DNA, 4242 bp, Homo sapiens
  Payload ID: 14515
  Gene Symbol: ARHGAP27
  Gene Name: Rho GTPase activating protein 27
  Uniprot ID: Q6ZUM4
  ENST ID: ENST00000428638
  CDS Start-End: 19-2688
gaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttga

SEQ ID NO: 175751 - DNA, 2296 bp, Homo sapiens
  Payload ID: 14515
  Gene Symbol: ARHGAP27
  Gene Name: Rho GTPase activating protein 27
  ENST ID: ENST00000528384
  CDS Start-End: 218-1783
cacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctga

SEQ ID NO: 175752 - DNA, 969 bp, Homo sapiens
  Payload ID: 14515
  Gene Symbol: ARHGAP27
  Gene Name: Rho GTPase activating protein 27
  ENST ID: ENST00000524404
  CDS Start-End: 420-653
cccgactggaaggagcccggggccctcattccttctcctccactgggaactgagtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcgtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggag

SEQ ID NO: 175753 - DNA, 3694 bp, Homo sapiens
  Payload ID: 14515
  Gene Symbol: ARHGAP27
  Gene Name: Rho GTPase activating protein 27
  ENST ID: ENST00000532038
  CDS Start-End: 137-2140
gctggagtctcagcctcccgccatctcggcaacttcttgtttccctgttgccctgtgccagcactggggtagtgcccctgggctctacccccaaaaccttcccagggctctgtcccggcagttcagaggggccaggatggtggacataatcgccaaagtgaccaggaggcagagtcgagccttgccggcacaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttga

SEQ ID NO: 175754 - DNA, 2604 bp, Homo sapiens
  Payload ID: 14515
  Gene Symbol: ARHGAP27
  Gene Name: Rho GTPase activating protein 27
  ENST ID: ENST00000532891
  CDS Start-End: 1-2604
atggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 175755 - DNA, 2319 bp, Homo sapiens
  Payload ID: 14515
  Gene Symbol: ARHGAP27
  Gene Name: Rho GTPase activating protein 27
  Uniprot ID: Q6ZUM4
  ENST ID: ENST00000528273
  CDS Start-End: 1392-2183
gcactgcttagtggacctcatttaatcttcccaataatccagtgaagtgggtgttactatcccattgacaggaaagaaatctgagctgcagagataaggcagaactcccaaggtgccaccaaggctcagacacacagattctcagaggaagtgtggactcacaggtgggcaatgcctagcagaggcaaagatatagaggtaagggagttccttacttactatatcttacaaagatatagaggtaagggagttccttacttactatatcttacaaagatatagaggtaagggagttcctctgaatctgggtggccagattcagcttcccacccaaccctgggtccccaggaggtggtgtcaagagaggccatggcctgggatgcgggcccttcttcctcccagaacactggcctgaatcagccagctcttggcacacacagccaggtccacaggcacaactgttccttggggcccctgagggcagggggtgtgctggggctgtggcttgtaatgtctggagtgagtgcaggctcagatcagggcgaggctgcttgtccagagaggcagaaaattctccaacagaagacccccaaggcggagggccctggggctggactcctggaggttgttctgagcttaccctgtggacggattggagggtggccctccttccccacaaggatcaagagggggtgggggatggtgggagggcaatctggccaggcgaacctgcgggggaggctcccgccctccccagtcccaccatctcagccccgcagcctctttctccctggagacagccaggtgcggcccaggatcccgggaaaggcaggggagggggtggcgtcttcgctcctcaggcgctggcccggcccagaggggacaggaagccaggacaccggggattgtctctcgcaaccgcagcccagccccagtccgggaggaagttctgcccggcgctctccgccggtgcctccctggttatattgttgaacaggaaacccggcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtacctccccgggcgctggggcgcggaggcgggtggcgcgctagggaccgcgcccgcacggagccggggcgcaaggagacccgctccgctcagcgtcgggcacgacgcccacctctgtccgaagacttcggatgagctccctctccccaaccgcgaaacgtgaggggtgcacgcccgcagtccctcatcagcaattcccaagctccaaagctccctggaagcccagaggcttttcgtaatccaattggtggcaaaattgcgcttgaactga

SEQ ID NO: 175756 - DNA, 780 bp, Homo sapiens
  Payload ID: 14515
  Gene Symbol: ARHGAP27
  Gene Name: Rho GTPase activating protein 27
  ENST ID: ENST00000528677
  CDS Start-End: 139-780
gggctggagtctcagcctcccgccatctcggcaacttcttgtttccctgttgccctgtgccagcactggggtagtgcccctgggctctacccccaaaaccttcccagggctctgtcccggcagttcagaggggccaggatggtggacataatcgccaaagtgaccaggaggcagagtcgagccttgccggcacaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaag

SEQ ID NO: 175757 - DNA, 4242 bp, Homo sapiens; identical to SEQ ID NO: 175750
  Payload ID: 14515
  Gene Symbol: ARHGAP27
  Gene Name: Rho GTPase activating protein 27
  Uniprot ID: Q6ZUM4
  ENST ID: ENST00000610792
  CDS Start-End: 19-2688

SEQ ID NO: 175758 - DNA, 3628 bp, Homo sapiens; identical to SEQ ID NO: 175749
  Payload ID: 14515
  Gene Symbol: ARHGAP27
  Gene Name: Rho GTPase activating protein 27
  Uniprot ID: Q6ZUM4
  ENST ID: ENST00000616021
  CDS Start-End: 435-2081

SEQ ID NO: 175759 - DNA, 3628 bp, Homo sapiens
  Payload ID: 14515
  Gene Symbol: ARHGAP27
  Gene Name: Rho GTPase activating protein 27
  Uniprot ID: Q6ZUM4
  ENST ID: ENST00000612916
  CDS Start-End: 435-2081
acatgagcaggcagccccgactggaaggagcccggggccctcattccttctcctccactgggaactgagtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagcgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcttctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcct

SEQ ID NO: 175760 - DNA, 1376 bp, Homo sapiens; identical to SEQ ID NO: 175748
  Payload ID: 14515
  Gene Symbol: ARHGAP27
  Gene Name: Rho GTPase activating protein 27
  Uniprot ID: Q6ZUM4
  ENST ID: ENST00000611188
  CDS Start-End: 450-1241

SEQ ID NO: 175761 - DNA, 4242 bp, Homo sapiens
  Payload ID: 14515
  Gene Symbol: ARHGAP27
  Gene Name: Rho GTPase activating protein 27
  ENST ID: ENST00000618949
  CDS Start-End: 19-2688
gaaaacgccgcggccgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtcctcacccgagccccgcggcccctgagccgctcgcctacgactaccggtttgtgagcgcggcggcgaccgcgggccccgacggcgcccccgaggagtccggaggccgaaccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagcgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcttctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttga

SEQ ID NO: 175762 - DNA, 1376 bp, Homo sapiens
  Payload ID: 14515
  Gene Symbol: ARHGAP27
  Gene Name: Rho GTPase activating protein 27
  ENST ID: ENST00000615350
  CDS Start-End: 450-1241
ggaagttctgcccggcgctctccgccggtgcctccctggttatattgttgaacaggaaacccggcagcgcgggagccgcacagtcgaggagggagggcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggccgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtcctcacccgagccccgcggcccctgagccgctcgcctacgactaccggtttgtgagcgcggcggcgaccgcgggccccgacggcgcccccgaggagtccggaggccgaaccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtacctccccgggcgctggggcgcggaggcgggtggcgcgctagggaccgcgcccgcacggagccggggcgcaaggagacccgctccgctcagcgtcgggcacgacgcccacctctgtccgaagacttcggatgagctccctctccccaaccgcgaaacgtgaggggtgcacgcccgcagtccctcatcagcaattcccaagctccaaagctccctggaagcccagaggcttttcgtaatccaattggtggcaaaattgcgcttgaactg

SEQ ID NO: 175763 - DNA, 3694 bp, Homo sapiens
  Payload ID: 14515
  Gene Symbol: ARHGAP27
  Gene Name: Rho GTPase activating protein 27
  ENST ID: ENST00000626761
  CDS Start-End: 137-2140
gctggagtctcagcctcccgccatctcggcaacttcttgtttccctgttgccctgtgccagcactggggtagtgcccctgggctctacccccaaaaccttcccagggctctgtcccggcagttcagaggggccaggatggtggacataatcgccaaagtgaccaggaggcagagtcgagccttgccggcacaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagcgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcttctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttga

SEQ ID NO: 175764 - DNA, 969 bp, Homo sapiens; identical to SEQ ID NO: 175752
  Payload ID: 14515
  Gene Symbol: ARHGAP27
  Gene Name: Rho GTPase activating protein 27
  ENST ID: ENST00000630485
  CDS Start-End: 420-653

SEQ ID NO: 175765 - DNA, 780 bp, Homo sapiens; identical to SEQ ID NO: 175756
  Payload ID: 14515
  Gene Symbol: ARHGAP27
  Gene Name: Rho GTPase activating protein 27
  ENST ID: ENST00000630545
  CDS Start-End: 139-780

SEQ ID NO: 175766 - DNA, 2604 bp, Homo sapiens
  Payload ID: 14515
  Gene Symbol: ARHGAP27
  Gene Name: Rho GTPase activating protein 27
  ENST ID: ENST00000627233
  CDS Start-End: 1-2604
atggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtcctcacccgagccccgcggcccctgagccgctcgcctacgactaccggtttgtgagcgcggcggcgaccgcgggccccgacggcgcccccgaggagtccggaggccgaaccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 175767 - DNA, 2296 bp, Homo sapiens
  Payload ID: 14515
  Gene Symbol: ARHGAP27
  Gene Name: Rho GTPase activating protein 27
  ENST ID: ENST00000630963
  CDS Start-End: 218-1783
cacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagcgtgggctgctga

SEQ ID NO: 175768 - DNA, 2276 bp, Homo sapiens
  Payload ID: 14515
  Gene Symbol: ARHGAP27
  Gene Name: Rho GTPase activating protein 27
  ENST ID: ENST00000628164
  CDS Start-End: 1349-2140
gcactgcttagtggacctcatttaatcttcccaataatccagtgaagtgggtgttactatcccattgacaggaaagaaatctgagctgcagagataaggcagaactcccaaggtgccaccaaggctcagacacacagattctcagaggaagtgtggactcacaggtgggcaatgcctagcagaggcaaagatatagaggtaagggagttccttacttactatatcttacaaagatatagaggtaagggagttcctctgaatctgggtggccagattcagcttcccacccaaccctgggtccccaggaggtggtgtcaagagaggccatggcctgggatgcgggcccttcttcctcccagaacactggcctgaatcagccagctcttggcacacacagccaggtccacaggcacaactgttccttggggcccctgagggcagggggtgtgctggggctgtggcttgtaatgtctggagtgagtgcaggctcagatcagggcgaggctgcttgtccagagaggcagaaaattccccaacagaagacccccaaggcggagggccctggggctggactcctggaggttgttctgagcttaccctgtggacggattggagggtggccctccttccccacaaggatcaagagggggtgggggatggtgggagggcaatctggccaggcgaacctgcgggggaggctcccgccctccccagtcccaccatctcagccccgcagcctctttctccctggagacagccaggtgcggcccaggatcccgggaaaggcaggggagggggtggcgtcttcgctcctcaggcgctggcccggcccagaggggacaggaagccaggacaccggggattgtctctcgcaaccgcagcccagccccagtccgggaggaagttctgcccggcgctctccgccggtgcctccctggttatattgttgaacaggaaacccggcagcgcgggagccgcacagtcgaggagggagggcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggccgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtcctcacccgagccccgcggcccctgagccgctcgcctacgactaccggtttgtgagcgcggcggcgaccgcgggccccgacggcgcccccgaggagtccggaggccgaaccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtacctccccgggcgctggggcgcggaggcgggtggcgcgctagggaccgcgcccgcacggagccggggcgcaaggagacccgctccgctcagcgtcgggcacgacgcccacctctgtccgaagacttcggatgagctccctctccccaaccgcgaaacgtgaggggtgcacgcccgcagtccctcatcagcaattcccaagctccaaagctccctggaagcccagaggcttttcgtaatccaattggtggcaaaattgcgcttgaactga

SEQ ID NO: 175769 - DNA, 969 bp, Homo sapiens; identical to SEQ ID NO: 175752
  Payload ID: 14515
  Gene Symbol: ARHGAP27
  Gene Name: Rho GTPase activating protein 27
  ENST ID: ENST00000631880
  CDS Start-End: 420-653

SEQ ID NO: 175770 - DNA, 2319 bp, Homo sapiens; identical to SEQ ID NO: 175755
  Payload ID: 14515
  Gene Symbol: ARHGAP27
  Gene Name: Rho GTPase activating protein 27
  Uniprot ID: Q6ZUM4
  ENST ID: ENST00000633003
  CDS Start-End: 1392-2183

SEQ ID NO: 175771 - DNA, 3694 bp, Homo sapiens; identical to SEQ ID NO: 175753
  Payload ID: 14515
  Gene Symbol: ARHGAP27
  Gene Name: Rho GTPase activating protein 27
  ENST ID: ENST00000631499
  CDS Start-End: 137-2140

SEQ ID NO: 175772 - DNA, 2604 bp, Homo sapiens; identical to SEQ ID NO: 175754
  Payload ID: 14515
  Gene Symbol: ARHGAP27
  Gene Name: Rho GTPase activating protein 27
  ENST ID: ENST00000632017
  CDS Start-End: 1-2604

SEQ ID NO: 175773 - DNA, 780 bp, Homo sapiens; identical to SEQ ID NO: 175756
  Payload ID: 14515
  Gene Symbol: ARHGAP27
  Gene Name: Rho GTPase activating protein 27
  ENST ID: ENST00000631510
  CDS Start-End: 139-780

SEQ ID NO: 175774 - DNA, 2296 bp, Homo sapiens; identical to SEQ ID NO: 175751
  Payload ID: 14515
  Gene Symbol: ARHGAP27
  Gene Name: Rho GTPase activating protein 27
  ENST ID: ENST00000632376
  CDS Start-End: 218-1783

SEQ ID NO: 175775 - DNA, 5369 bp, Homo sapiens
  Payload ID: 14516
  Gene Symbol: ARHGAP28
  Gene Name: Rho GTPase activating protein 28
  Uniprot ID: Q9P2N2
  ENST ID: ENST00000262227
  CDS Start-End: 3212-5224
ctctgtcgcccaggctggagtgcagtagagtgatctcggctcactgcaagctccacctcctgggttcacgccattctcctgcctcagccttccgagtagcttggactacaggcacccaccaccacacccagctaatttttttgtattttttttagtagagacggggttttaccatgttggccaggatggtcttgatctcctgacctcatgatccacctgcctcggcctcacaaagtgctgggattacaggtatgagccaccacgcccggccaggcatttctttatagcaatgccaggatggtgtgccagactgtatcagagacaagtgatacaaagatgaccaagatacagtacttgcccaggaagaagaattcctgtggccacctctgtcttatatcaagagataagtgtgaaacagagtatccacaacagtgtttgggaagacagtgtgagtggctcccaactctaccaacaaaggcttcaaaggagtaatgacatttgaattgagtcttaaaggataaatgtattacttggcctgacaacacagaagaaaaggtcatttttgtcaaagaaatcaaccttgaaaaaatgccgcagttcatgacttgtaccagtgaaggtagcaaggtctgtgtgttggtgatgaatttgcaggggatcaggctgaagaaacaagacttgggagagaggatgtgagacctttttatgacatgcatagagttggcacctcagcctttgcatggtagggagctagctgaaggctacctccatgacagatgtacactttgaaaagacaggccgggtgcggtggctcacgtctgtaatcccagcattttgggaggctgaggtgggcaaatcacttgaagtcaggagttagagatcagcctggccaacacagtgaaacctggtctctactaaaaaaaataaaataattagccaggcatggtggcgcacacctgtaatcccaactattcgggaggctgaggcagaagaattgcttgaacacgggaggcggaagttgcagtgagctgagatggcaccaccgcactccagcctgggcgacagatcaagactccatctcaaaataaaggaagatacagctaatctatatttctttcaccagagatcaccaccactaacaattcatactggtcgtttttccctgaatgttttacctatgtaggaaaattttacatcccaatttttaatttaacactatgaaaagcatttctttttataataaagacactctattagtatacttttgatggcttcaaaactacttttgtatagatgcaaaattaaaatatcaaattgtttcttttgtttgtttgtttttttgttttttttttgagacagagtctcactctgtcgcccaggctaaagcacagtggcatgatctcggctcactgcaagcttttcctcccaggttaaagtgattctcatgccgcagcctcccgagaagctgggactacaggtgtgcaccaccacccccggctaattttttgtatttttacaaaacacaaagagagacggggtttcaccatgttgggcaggctggtctcaaactcctgacctcaggtgatccgcctgcctcagcctcccaaagtgctgggattgcaggcgtgggccaccgtgccctgcctcaaattgtttctttaatggttgttcccaaattttcataaataactttttacgtaacatttttgggcataaagttgtctaaaattattttcataggctagataccttaagtacacttaatgatttaaatcatacttaacattaagactttaatgttgctatattgatatttagtaaaagtacaaaacttgtgctttagagtttagacatattcaggatataagatagttttgttggatttggcgaacacttgccctaggagaataaaaaatgatgaattagtccaaaatgttccagttttctaatttgtcagactcggtaaatggtatcatcaccaaccaagaaaaacagaagatacagggagagtagattttgcagaaaagataaggagttctgtttgggacttgctgcctttgatatactgcactgggagaaaatccaagtcgaacagagtggacaagtgagaatgtgctgtggaatcaacaagaggggtggggagtctacctacctagatttgagagcagtttggcaaataattgttagtaaatgtcatagaaattcgtgggagagagaagttgataagaacagaggggtaaaggatgaaacagaggaaacactgccgcttctcagggttgggtacaagagaagccagggaaatagactaagaaagagtgatcagggaaaccgggagacagtgttgtcacggaagcctggagtgtgagattttccagaaaagaaggaatgaaagaatgaatggtctgtagatccattactcagcactatcagacacattgtccccttttgatatcccataatgaaatttatagataatataatctacttgtgcacaaaattttagaaattaatataatgccccaactataatataaagtgtattagtcagggttctctagagggacagaactaataggatatatatatataaaggggagtttataaagtattaacttacactattacaaggtcccacaataggctgtctgcaagcttgaggagcagagagccaggctgagtctcaacactgaagaacttggagtccgatgttcgagggcaggaaaaatccagcacaggagaaagacgcaggctgggaggctaggccagtctctcctttccatgttcctctgcctgctttatattcactggcagctgattggattgtgcccaccagattaagggtggatctgccttccccagcccactgactcaagtattaatctcttttgacaacaccctcacagacacacccaggatcaatatttgtatccttcaatccaattaagctgacactcagaattaaccatcacataaaggaagaagtaaaaggaaagtatattttatataataagtatttaaatatgtaaacattgggacatgactaaaactgactgaacacattgaaggagtcacttggttggtctgatgtgcagaattaccatgcatgctacaaatggagaggggtctacatgagctgtattgcttgtggtgccgcagatgacttgaatttccagaatgaaaatccattcctcgctgccgaagaattaacaggatgctctccaatgaatccctccatcctcctgccttcagccgttccaactcagaagcctccgtagacagcgcctccatggaggatttctggcgggaaatagaaagtattaaagacagcagcatgggagggcaagaagagccaccgccagctgaggtcacacctgtggatgaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagaatactgcactggcagcgagctgcactttccttcctaaatggaaaatgggttaaaaaagaaagagaagagtcgacagagaccaacaggagccccaaacatgtattcctcttcactattggcctggacatctccacataggcagtcatatagagacttgaaatatcattcaagggatttgggtatccagtagacttttagttacatatactacaaaactgactttgtactctcaagtagacctttcgtagaaagaaaatgtttctaataaaaatgtattagaact

SEQ ID NO: 175776 - DNA, 5415 bp, Homo sapiens
  Payload ID: 14516
  Gene Symbol: ARHGAP28
  Gene Name: Rho GTPase activating protein 28
  Uniprot ID: Q9P2N2
  ENST ID: ENST00000314319
  CDS Start-End: 157-1869
acagaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagtcatggttcatcagaatgtattaagattcagaaccaaaggttatatgaaattggaggaaatataggagagcattgcttggatccagatgcttatatattggatgtatatcgtataaatcctcaagcagaatgggtgattaaaccccaacaaagttcttaaaatatcctcgagagagctgctatcatgtattatatgccaaaaagatcctacattttggtagggaaaaaacaacactgtgtttgacgtatttgttcctacagcattctcagtatttctggccctcagcagtgggcattgtaagcatgaactatggaagaggcgccggttcaccaattcaactgaagctttctcatgacttttttttttataaaagtaaaggaaagatgatgtggtccttccagaagaaagaccaatctagaatatggaactctaatcacttctagtatttcaacttcctagcagaaatgaacttggccctagacctagggataagcaatgttctttatgtagccaatgctacgaaacaaaagaggtgaaagagacccttttttatacttaatgtacatatattgactttttgagcaagaatgccagaaatagccttcatttctaccctgcaaaataatccagatctgctttctaaaatgaatcagtttctaaagtgaaacatgcaatatttatgctctgactgactcctgaattggaagaggaagaacttctgtttacagaaaactgtattgttatatatgtcaggctgtgtattgtgactatcagcattctggtgcaaatgaacttttctccatcatcgactgtggaaaattgatacttttaaagcatattcttctatgagcacaggtcctcctagtgaagcttagtttgacaaagggtgtcatatgctttcctaacctgatttgtagttaacattcacagagcctacattttctcattacggttatgatgctcagtatctttccaagtgccaggcacgggcttccttttctgatcaaacataccattttttatatttcacaactatagacagtcacttctgcagtcccaatttaaaaatgcagaactgctttatccaagaatgctgaaaaatactgttctatccaggtttcctaaactataaaagcagattttgcttttgtttgttaatcataggcatggccgagcattgtggattagcctgaggcttaaaatcagatgcatgtctggtaagatgaccactgtctcactatcaagagcctgcagagccattttccagacctgtgattgcccagaacacatagtccccacgtttctaatttggagcaaatctaaaaggtgctgagggattggacagctctgactttcctcgagactatggatatagtccttctcagattagctggaaatggggacagagttctcatttatcccagatatatacattggcttttttggaatctatagattgagattttgatgaatttatattggttttaatgagacccaaatgactctctcttaacaattcaagcagtagacaaagttgctcacaaatacagaaaacatctttttgtctacttcgcaagtctcaaaacgtgataatatttaagcccatttgtagaagaaatcttgtatatactattattacaccttgatatctatacaaaacatcacttgtattaaaatatatagataactttctggcatttagaattttgttccattcatttaatttgttcatctgagaatttttttttttgcctgaaaacccattaaaagaaaacgtgccttctgtataagtttatgtttattcctacattttattcatttttaatgtatgggtaattggtggcacatgactttacataatgactttctagactctgaaaaaaatgcttttatcatttttgcaattcagacaagggtaaacattttactttatgtaattgccacatcccaagatgtaaaacggcagtaatttatgaccacgtatggaagaaattcttcaaatagctaccttacatttctgcgtatatatgaaaactgaatgatatttctcagtgtatttccttgcatttgaatggttcaattctgttgtgtttatgtagaaaattcacaaatctgttcatttaattttttaatttgagaatttttatttcttttgactgaaaacacattagaacctatgagtaaattctgaaggttttaagatttacttcagcttgtcaccagtttcaaataaatccctaataggtaacaagtaaaatacaaattcttgtctactttcatgtggttttaaatggcagggacttcgctgagtcagtaagtataatcactctagtttattcaaggatgtgtggcaactttcaacttccatacgtatatatgtatgtatggaaggccatgtcaatactagtatcattggatataactttgattcttaatcagagggcaaattcattagagaagaatttttagtagatacacagactaatatttgtgtggaggttcttttgaccaattttattcctaagaataaacaaacccctacagttaaaatgcaaagatgcctgtcatctaagtattgaaagaatttttgccttatcaagagttgttttttaaaaatttaataaattcataaaaaagactcatatctttgcaaacaaaagaagggcagatactgggcttctacatgctatccttaagagcttctccccctcacccattcctagtgctcttggtatacacttgggaaaataatgtcctccaggagaaagtgttagagggaactaacattttaggaatgcttattcagaaaaaaatcctagagttgattcattgttttcctccatcctgcaaaagaagatccctttgttaagcagctcacttggaaatatgattcttggagtcaatgatctctaaacaaactggattatcaactatttacaacgtctatacagtataaactacctcacttgcctttcttgggaaaaaaaaaatgaatggactttaacaattgttgttacaaactgtgcctgaatcttattatttaaatcacttcagttagctttcagtgtatgtttaataatatacatttaatgatgaaaaatattttcagcaaagctttaaaaccagaaatactgtgtaactgtgatctatgtggtatactctgagagaattctgtgtcctgctcattgtcttgagtttctaaccatgtgcagatgcaagcgttcaggagtaggaattaatgtccatcttttctttcaggcattttcatctgctgtccacgtatttcacttgactgaaagctcatatgagttaaaatgtcccttcttcctagcgagcatatttcaactgttcttcataaatgtttatgtgccttaaaagactttatgttaaaggattaaatagtttctctgacaggcagtttttaactgttttccacaaataaaaataatatgtcatgggattaaaatgtttgttttcaagcatttttaacagttttacacacttacatacaccttaattaaaaatttttttctgtcagacatttaccaactattttctaaaactaatttgacaaatcatgacactagaaaacgccaatgttttatgtctttgcccatctcaaaagctaatattgattcttctgttccatcagctttcattgttaagtagaatatgtatgttgcattttatccataagaaataaag

SEQ ID NO: 175777 - DNA, 2295 bp, Homo sapiens
  Payload ID: 14516
  Gene Symbol: ARHGAP28
  Gene Name: Rho GTPase activating protein 28
  Uniprot ID: Q9P2N2
  ENST ID: ENST00000383472
  CDS Start-End: 105-2294
acctcgggccgcgccgcccagctgctgacagcctcccggcgcgccggtccatgctggtcccggtctttgttctggggccggcgccgagacatgcgcggctgacgatggaggtggaggactcgggcggcgtggtgctgaccgcctaccactcgtacgcgcgcgcccagccccccaacgccgagtcgcgctgcgcgccccgcgccgcagccagccacccgctcagcagaaaatccattcctcgctgccgaagaattaacaggatgctctccaatgaatccctccatcctcctgccttcagccgttccaactcagaagcctccgtagacagcgcctccatggaggatttctggcgggaaatagaaagtattaaagacagcagcatgggagggcaagaagagccaccgccagctgaggtcacacctgtggatgaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagtcatggttcatcagaatgtattaagattcagaaccaaaggttatatgaaattggaggaaatataggagagcattgcttggatccagatgcttatatattggatgtatatcgtataaatcctcaagcagaatgggtgattaaaccccaacaaagttcttaaa

SEQ ID NO: 175778 - DNA, 5492 bp, Homo sapiens
  Payload ID: 14516
  Gene Symbol: ARHGAP28
  Gene Name: Rho GTPase activating protein 28
  Uniprot ID: Q9P2N2
  ENST ID: ENST00000419673
  CDS Start-End: 218-1930
aaagtaggccagtattgccagagaacaggagaggaggagagtatggtataagcatgtccagaaataaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagtcatggttcatcagaatgtattaagattcagaaccaaaggttatatgaaattggaggaaatataggagagcattgcttggatccagatgcttatatattggatgtatatcgtataaatcctcaagcagaatgggtgattaaaccccaacaaagttcttaaaatatcctcgagagagctgctatcatgtattatatgccaaaaagatcctacattttggtagggaaaaaacaacactgtgtttgacgtatttgttcctacagcattctcagtatttctggccctcagcagtgggcattgtaagcatgaactatggaagaggcgccggttcaccaattcaactgaagctttctcatgacttttttttttataaaagtaaaggaaagatgatgtggtccttccagaagaaagaccaatctagaatatggaactctaatcacttctagtatttcaacttcctagcagaaatgaacttggccctagacctagggataagcaatgttctttatgtagccaatgctacgaaacaaaagaggtgaaagagacccttttttatacttaatgtacatatattgactttttgagcaagaatgccagaaatagccttcatttctaccctgcaaaataatccagatctgctttctaaaatgaatcagtttctaaagtgaaacatgcaatatttatgctctgactgactcctgaattggaagaggaagaacttctgtttacagaaaactgtattgttatatatgtcaggctgtgtattgtgactatcagcattctggtgcaaatgaacttttctccatcatcgactgtggaaaattgatacttttaaagcatattcttctatgagcacaggtcctcctagtgaagcttagtttgacaaagggtgtcatatgctttcctaacctgatttgtagttaacattcacagagcctacattttctcattacggttatgatgctcagtatctttccaagtgccaggcacgggcttccttttctgatcaaacataccattttttatatttcacaactatagacagtcacttctgcagtcccaatttaaaaatgcagaactgctttatccaagaatgctgaaaaatactgttctatccaggtttcctaaactataaaagcagattttgcttttgtttgttaatcataggcatggccgagcattgtggattagcctgaggcttaaaatcagatgcatgtctggtaagatgaccactgtctcactatcaagagcctgcagagccattttccagacctgtgattgcccagaacacatagtccccacgtttctaatttggagcaaatctaaaaggtgctgagggattggacagctctgactttcctcgagactatggatatagtccttctcagattagctggaaatggggacagagttctcatttatcccagatatatacattggcttttttggaatctatagattgagattttgatgaatttatattggttttaatgagacccaaatgactctctcttaacaattcaagcagtagacaaagttgctcacaaatacagaaaacatctttttgtctacttcgcaagtctcaaaacgtgataatatttaagcccatttgtagaagaaatcttgtatatactattattacaccttgatatctatacaaaacatcacttgtattaaaatatatagataactttctggcatttagaattttgttccattcatttaatttgttcatctgagaatttttttttttgcctgaaaacccattaaaagaaaacgtgccttctgtataagtttatgtttattcctacattttattcatttttaatgtatgggtaattggtggcacatgactttacataatgactttctagactctgaaaaaaatgcttttatcatttttgcaattcagacaagggtaaacattttactttatgtaattgccacatcccaagatgtaaaacggcagtaatttatgaccacgtatggaagaaattcttcaaatagctaccttacatttctgcgtatatatgaaaactgaatgatatttctcagtgtatttccttgcatttgaatggttcaattctgttgtgtttatgtagaaaattcacaaatctgttcatttaattttttaatttgagaatttttatttcttttgactgaaaacacattagaacctatgagtaaattctgaaggttttaagatttacttcagcttgtcaccagtttcaaataaatccctaataggtaacaagtaaaatacaaattcttgtctactttcatgtggttttaaatggcagggacttcgctgagtcagtaagtataatcactctagtttattcaaggatgtgtggcaactttcaacttccatacgtatatatgtatgtatggaaggccatgtcaatactagtatcattggatataactttgattcttaatcagagggcaaattcattagagaagaatttttagtagatacacagactaatatttgtgtggaggttcttttgaccaattttattcctaagaataaacaaacccctacagttaaaatgcaaagatgcctgtcatctaagtattgaaagaatttttgccttatcaagagttgttttttaaaaatttaataaattcataaaaaagactcatatctttgcaaacaaaagaagggcagatactgggcttctacatgctatccttaagagcttctccccctcacccattcctagtgctcttggtatacacttgggaaaataatgtcctccaggagaaagtgttagagggaactaacattttaggaatgcttattcagaaaaaaatcctagagttgattcattgttttcctccatcctgcaaaagaagatccctttgttaagcagctcacttggaaatatgattcttggagtcaatgatctctaaacaaactggattatcaactatttacaacgtctatacagtataaactacctcacttgcctttcttgggaaaaaaaaaatgaatggactttaacaattgttgttacaaactgtgcctgaatcttattatttaaatcacttcagttagctttcagtgtatgtttaataatatacatttaatgatgaaaaatattttcagcaaagctttaaaaccagaaatactgtgtaactgtgatctatgtggtatactctgagagaattctgtgtcctgctcattgtcttgagtttctaaccatgtgcagatgcaagcgttcaggagtaggaattaatgtccatcttttctttcaggcattttcatctgctgtccacgtatttcacttgactgaaagctcatatgagttaaaatgtcccttcttcctagcgagcatatttcaactgttcttcataaatgtttatgtgccttaaaagactttatgttaaaggattaaatagtttctctgacaggcagtttttaactgttttccacaaataaaaataatatgtcatgggattaaaatgtttgttttcaagcatttttaacagttttacacacttacatacaccttaattaaaaatttttttctgtcagacatttaccaactattttctaaaactaatttgacaaatcatgacactagaaaacgccaatgttttatgtctttgcccatctcaaaagctaatattgattcttctgttccatcagctttcattgttaagtagaatatgtatgttgcattttatccataagaaataaagagaaaaaaactaaaaa

SEQ ID NO: 175779 - DNA, 709 bp, Homo sapiens
  Payload ID: 14516
  Gene Symbol: ARHGAP28
  Gene Name: Rho GTPase activating protein 28
  ENST ID: ENST00000532723
  CDS Start-End: 359-709
attagttcttcacttagagaagaaactccattgccctttgtttctggccctgtgcggctggaggcggccagcactgtcctgtcctggttgaagcaattttaatgtgtgtggggtgctgaatgtgggctggggatggcttccctgcctttgggtcatggggagacacacttgcagaggggttttgtgggtcttcctcaagaatatcatccctgaaatttttaacctgctaaaagaatcaccacttcacatctgtaagcagagcgctggctaactctgtggcttaagcagaggtcagaacatctgaagtgatctgcagatatcctgaaaatccattcctcgctgccgaagaattaacaggatgctctccaatgaatccctccatcctcctgccttcagccgttccaactcagaagcctccgtagacagcgcctccatggaggatttctggcgggaaatagaaagtattaaagacagcagcatgggagggcaagaagagccaccgccagctgaggtcacacctgtggatgaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagg

SEQ ID NO: 175780 - DNA, 1859 bp, Homo sapiens
  Payload ID: 14516
  Gene Symbol: ARHGAP28
  Gene Name: Rho GTPase activating protein 28
  Uniprot ID: Q9P2N2
  ENST ID: ENST00000532996
  CDS Start-End: 75-1712
caggaagctagcagagtttgcttctgagacgaattctgttacagtacatggcatttatgaggatcaatgtaattatgaatgaattgcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagaatactgcactggcagcgagctgcactttccttcctaaatggaaaatgggttaaaaaagaaagagaagagtcgacagagaccaacaggagccccaaacatgtattcctcttcactattggcctggacatctccacataggcagtcatatagagacttgaaatatcattcaagggatttgggtatccagtagacttttagttacatatactacaaaactgactttgtactctcaagtagacctttcgtagaaagaaaatgtttctaataaaaatgtattagaactaa

SEQ ID NO: 175781 - DNA, 2171 bp, Homo sapiens
  Payload ID: 14516
  Gene Symbol: ARHGAP28
  Gene Name: Rho GTPase activating protein 28
  ENST ID: ENST00000531294
  CDS Start-End: 213-1910
aggccagtattgccagagaacaggagaggaggagagtatggtataagcatgtccagaaataaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaaatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagtcatggttcatcagaatgtattaagattcagaaccaaaggttatatgaaattggaggaaatataggagagcattgcttggatccagatgcttatatattggatgtatatcgtataaatcctcaagcagaatgggtgattaaaccccaacaaagttcttaaaatatcctcgagagagctgctatcatgtattatatgccaaaaagatcctacattttggtagggaaaaaacaacactgtgtttgacgtatttgttcctacagcattctcagtatttctggccctcagcagtgggcattgtaagcatgaactatggaagaggcgccggttcaccaattcaactgaagctttctcatgacttttttttttataaaagtaaaggaaagatgatgtggtccttccagaagaaagaccaatctagaa

SEQ ID NO: 175782 - DNA, 443 bp, Homo sapiens
  Payload ID: 14516
  Gene Symbol: ARHGAP28
  Gene Name: Rho GTPase activating protein 28
  ENST ID: ENST00000584387
  CDS Start-End: 31-443
tggatgttgtttcaagttttggtggactagatgagtgagcctggggttctttgcattgtctttgactggagaaaatccattcctcgctgccgaagaattaacaggatgctctccaatgaatccctccatcctcctgccttcagccgttccaactcagaagcctccgtagacagcgcctccatggaggatttctggcgggaaatagaaagtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttat

SEQ ID NO: 175783 - DNA, 629 bp, Homo sapiens
  Payload ID: 14516
  Gene Symbol: ARHGAP28
  Gene Name: Rho GTPase activating protein 28
  ENST ID: ENST00000581099
  CDS Start-End: 296-629
aaagtaggccagtattgccagagaacaggagaggaggagagtatggtataagcatgtccagaaatgaaactcgtttgtactggcagatgctataagaagagagccctgactggaaataagctaggttcaggtgtgttggccagaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtg

SEQ ID NO: 175784 - DNA, 608 bp, Homo sapiens
  Payload ID: 14516
  Gene Symbol: ARHGAP28
  Gene Name: Rho GTPase activating protein 28
  ENST ID: ENST00000579689
  CDS Start-End: 1-608
gaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaacaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcat

SEQ ID NO: 175785 - DNA, 535 bp, Homo sapiens
  Payload ID: 14516
  Gene Symbol: ARHGAP28
  Gene Name: Rho GTPase activating protein 28
  ENST ID: ENST00000577524
  CDS Start-End: 153-326
aaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaa

SEQ ID NO: 175786 - DNA, 462 bp, Homo sapiens
  Payload ID: 14516
  Gene Symbol: ARHGAP28
  Gene Name: Rho GTPase activating protein 28
  ENST ID: ENST00000583410
  CDS Start-End: 243-462
acccggagccgctcccaccagggcggcgcagtcgcgctgggcttggggggttcgccgtgcagctgcgccttgtgcctgagcgcacgaccgccgtcactggatgttgtttcaagttttggtggactagatgagtcaatttcccaaggatcttcataagtaatattgtgaaatgaagccctggacctgggaacctgaatttgccagctaagtttcccaagtagactatatgtctgagtgaataaatgaatttgatccaaggaaaatccattcctcgctgccgaagaattaacaggatgctctccaatgaatccctccatcctcctgccttcagccgttccaactcagaagcctccgtagacagcgcctccatggaggatttctggcgggaaatagaaagtattaaagacagcagcatgggagggcaagaagagccaccgccagctgaggtcacacctgtggatg

SEQ ID NO: 175787 - DNA, 517 bp, Homo sapiens
  Payload ID: 14516
  Gene Symbol: ARHGAP28
  Gene Name: Rho GTPase activating protein 28
  ENST ID: ENST00000584287
  CDS Start-End: 153-326
aaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgtactaccctgtctgacgcatcccaggataaagaagggagttttgcggttcccaggagtgactctgtggctatacttgagaccattccagttctaccagttcattccaatggatcaccggagcctggacagccagttcagaatgcgataaatgatgattttctggaaaagaacattccaccagaggctgaagagctgtcatttgaag

SEQ ID NO: 175788 - DNA, 6087 bp, Homo sapiens
  Payload ID: 14517
  Gene Symbol: ARHGAP29
  Gene Name: Rho GTPase activating protein 29
  Uniprot ID: Q52LW3
  ENST ID: ENST00000260526
  CDS Start-End: 184-3969
gctgtggctgcggctgcggctgcggctgagatttggccgggcgtccgcaggccgtgggggatgggggcagcgagctccagccctcggcggtggcggcggccgtaggtgtggggcgggcgtccgcgtccggcacgcgagatggagcgccgtggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtagaagaagcaaatgaactttacaaagtttgtgtgacaaatgttgaagaaagaagaaatgatctagaaaataccaaaagagaaattttagcacaactccggacacttgttttccagtgtgatcttacccttaaagctgtaacagttaacctcttccacatgcagcatctgcaggctgcttcccttgcagacagtttacagtctctctgtgatagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacacaagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtcaagctttggaaaatggaatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggcccacaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcagtgcctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaaggtgaaattccacaatttgtgtagggatgtcaaatttcagggtttttttgttgttgttgtgttattttgtggtattgtgcttgttttgtgaaagaatgttttgacagggcctcttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaattttatagtgcatctttcaccatttgtgcttttttaagatacgtatgtaagctcttatttttcaattggcaattcagttaatttttaaatgtttacataatggccagaaggcttgcaaatctgtatttaattgcattttaattaattgccagtttttacatgtgatagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaaggtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatatatcaacttgttaaattatttcatgttcccgtggcttcttttcagttgttgcctattacagtatgagagtttaaggttattaaccattggcttagaagtcaacacctaggatcatacatccgttgactacaatgtggaatgaattttatggaaacctgttttatagttctatgtgatgtaaaggtctagggagcaataaccagcccttttttttctgaaggcttgtttttagtcctcattgtacaaaatataaaataatcatattgctatgaatacctaaaaagaaaattagagcccatgtgtattgagccttctctgtgtgccaggaactttgccaaggtgctacatagattattttatttcaagttcacagcaacctataatgggtgggtaagcatgttattatttctgtgttacagataaggaaactaaggcttagttaaatgacttgcttcagtgttccacaggtgtaacaggtggagtcaaatctcaaacatagggctgtcagattttgatggttagtgctcttaatgactgtgattactaaataatatctggtagtttttaacaatagaaaatgcaactttaaaaaatttttattgtggtaaaatacacataacatttaccatttttaagtatattgtttgaaccatttttaagcatatagttcagtggcattaagtatattcacattgttttgcaaccatgagcacctattcatctccagaacattatcatcatcctatactaaaacttagaaaatgtacttttaaacttcttcagttctcttttaatatatggagcccacccaaaggttatatcatgtaataaactcatttctctgttttccctcacagcttaaaaa

SEQ ID NO: 175789 - DNA, 2043 bp, Homo sapiens
  Payload ID: 14517
  Gene Symbol: ARHGAP29
  Gene Name: Rho GTPase activating protein 29
  Uniprot ID: Q52LW3
  ENST ID: ENST00000370217
  CDS Start-End: 252-1433
gggcgggcggtgcggccgtggcggtagctgcaggggcggtggcggctgcagtggtggtggtgcctgtggctgtggctgcggctgcggctgcggctgagatttggccgggcgtccgcaggccgtgggggatgggggcagcgagctccagccctcggcggtggcggcggccgtaggtgtggggcgggcgtccgcgtccggcacgcgagatggagcgccgtggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtaacgatctttttcttttttatttgcaagttgaattagcggtaatctgccaggagtttggtgtcaaagttctgcgtctgccaagactgcctggaaaggcatgttaaaacatggctaagcccatcccccagagtttctcattcagtaggtcaacattttttaataggctctcaggtcgtgctgatgctgttggtgaagatccacattttgagaaccactatgctgagacctgaattttggagtttgtgaaagaatgtcttagagaaggcagtagtttattttacttgacaagaaagttcaccttttaggcaagtgtgtgtgtgtatgtgtactaattcaggcacctgatagcaaggataggcaaaagctttgtattattgatgaaatgtaattttacgaacaaattctgtaagattatatggaatatagtaaatataaatataaaatgctatttcaaatagaagcaaatattttatagacagtgtactaattataaattgtacatggctgtccattaaaatcaactgcctttgaatcactgaccagaacagattaacttcagaagtattattttgaaaacagaagatttcagaattttcagttatttcaacttagctttactatagtaaatatttgtttaaaatataaa

SEQ ID NO: 175790 - DNA, 3439 bp, Homo sapiens
  Payload ID: 14517
  Gene Symbol: ARHGAP29
  Gene Name: Rho GTPase activating protein 29
  ENST ID: ENST00000552844
  CDS Start-End: 90-3197
agaacccctggtaggttaatccaggcttacccacttgctctacatgctgctctttgggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtagaagaagcaaatgaactttacaaagtttgtgtgacaaatgttgaagaaagaagaaatgatctagaaaataccaaaagagaaattttagcacaactccggacacttgttttccagtgtgatcttacccttaaagctgtaacagttaacctcttccacatgcagcatctgcaggctgcttcccttgcagacagtttacagtctctctgtgatagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacacaagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtcaagctttggaaaatggaatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggcccacaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgagactttaatacaaaattaccgtgtacttcatctacaatatgtcttctgctgctgatctagatctgagctgtccgatacagctgccagaagccacaggtgacgttatattcctattcgaagaccaagagctcaaaacatcattcctcccccaaatgaaaaaatgtctgggaaaaattactaatctacttctctgaaacccatttgggaagctggcccaattcgagttctatactcaaaaggcaaacgtaaagactaaacctaagacaccaggtttttagccttggatcaagatgtctc

SEQ ID NO: 175791 - DNA, 4394 bp, Homo sapiens
  Payload ID: 14518
  Gene Symbol: ARHGAP30
  Gene Name: Rho GTPase activating protein 30
  Uniprot ID: Q7Z6I6
  ENST ID: ENST00000368013
  CDS Start-End: 322-3627
gttaaggagctgcactgcttcctgccccctaaagctgagcggggcgaggagggcgagtgccaggctgggccacgagacacaggacacaatttcttgccagggtcctggtagcttcctcttcaacagccacttccgtgtggccggggccccaggggcaggagctgctgcccgttgcccaggccaccctccacccccaattgggagccctgcccccctggggccgggccaagcccagcagctggctgggatcccatgggggactggtagggcacaggtcttgggggatagaggtgaccgggccagtgccctggggctctggccatgaagtctcggcagaaaggaaagaagaagggcagcgcaaaggagcgggtttttgggtgcgacttgcaggagcacctgcagcactcaggccaggaggtgccccaggtgctaaagagctgtgcagaatttgtggaggagtatggagtggtggatgggatctaccgcctctcaggggtctcctccaacatccagaagcttcggcaggaatttgagtcagagcggaagccagacctgcgtcgggatgtttacctccaagacattcactgcgtctcctccctgtgcaaggcctatttcagagaactgccggatcccctgctcacttaccggctctatgacaagtttgctgaggctgtaggagtgcaattggaacctgagcgcttggtcaagatcctagaggtgcttcgggaactccctgtcccaaactacaggaccctggagttcctcatgaggcacttggtacacatggcctcattcagtgcccagaccaacatgcatgctcgcaacctggccatcgtgtgggctcccaacctgctgaggtctaaggacatagaggcctcaggcttcaatgggacagcggccttcatggaggtgcgggtacaatccatcgtcgtggagttcatcctcacacacgtggaccagctctttgggggtgctgccctctctggtggtgaggtggagagtgggtggcgatcgcttccagggacccgggcatcaggcagccccgaggaccttatgcccaggccactgccttatcacctgcctagcatactgcaggctggcgatggacccccacagatgcggccctaccatactatcatcgagattgcagagcacaagaggaaggggtctttgaaggtcaggaagtggaggtctatcttcaatttaggtcgctctggccatgagactaagcgtaaacttccacggggggctgaggacagggaggataaatccaacaaggggacactgcggccagccaaaagcatggactcactgagtgctgcagctggggccagtgatgagccagaggggctggtggggcccagcagcccccggccaagcccattgctgcctgagagcttggagaacgattctatagaggcagcagagggtgaacaggagcctgaggcagaagcactgggtggcacaaactctgaaccaggcacaccacgagctgggcggtcagccatccgggctgggggcagcagccgtgcagaacgctgtgctggtgtccacatctcagacccctacaatgtcaacctcccgctacacatcacctctatcctcagtgtgcccccgaacatcatctctaacgtttccttggccaggctcacccgtggccttgagtgccctgctctacagcaccggccaagccctgcctctggccctggccctggccctggccttggccctggccccccagatgaaaagttggaagcaagtccagcctcaagtcccctggcagactcaggcccagacgacttggctcctgccctggaggactcgctgtcccaggaggtgcaggactccttctccttcctagaggactcaagcagctcagaacctgagtgggtgggggcagaggatggggaggtggcccaggcagaagcagcaggagcagccttctcccctggggaggacgaccctgggatgggctacctggaggagctcctgggagttgggcctcaggtggaggagttctctgtggagccacccctggatgacctgtctctggatgaggcacagtttgtcttggcccccagctgctgttccctggactccgctggccccaggcctgaagttgaggaggaaaatggggaggaagttttcctgagtgcctatgatgacctaagtccccttctgggacctaaacccccaatctggaagggttcagggagtctggagggagaggcagcaggatgtggaaggcaggctctgggacagggtggggaagagcaggcatgctgggaagttggggaggacaagcaggctgagcctggaggcaggctagacatcagggaagaggcagagggaagtccagagaccaaggtggaggctggaaaggccagtgaggatagaggggaggctgggggaagccaagagacaaaagtcagattgagagaagggagtagggaagagacagaggccaaggaagagaagtccaaaggtcagaagaaggctgacagtatggaggctaaaggtgtggaggaaccaggaggagatgagtatacagatgagaaggaaaaagaaattgagagagaagaggatgaacaaagagaggaagcccaggtagaagctggaagggacctagagcaaggggcccaggaagatcaagttgctgaggagaaatgggaagttgtacagaaacaagaggctgagggagtcagagaggatgaggacaaaggacagagggagaaggggtaccatgaagcaagaaaagaccaaggagatggtgaagacagcagaagcccagaagcagcaactgaaggaggagcaggggaggtcagcaaggaacgggagagtggggatggagaggctgagggagaccagagggctggagggtactatttagaagaggacaccctctctgaaggttcaggtgtagcgtccctggaggttgactgtgccaaagagggcaatcctcactcttctgagatggaagaggtagccccacagccacctcagccagaggagatggagcctgaggggcagcccagtccagacggctgtctatgcccctgttctcttggcctgggtggcgtgggcatgcgtctagcttccactctggttcaggtccaacaggtccgctctgtgcctgtggtgccccccaagccacagtttgccaagatgcccagtgcaatgtgtagcaagattcatgtggcacctgcaaatccatgcccgaggcctggccggcttgatgggactcctggagaaagggcttgggggtcccgagcttctcgatcctcttggaggaatgggggtagtctttcctttgatgctgctgtggccctagcccgggaccgccaaaggactgaggctcaaggagttcggcgaacccagacctgtactgagggtggggattactgcctcatccccagaacctccccttgtagcatgatctctgcccattctcctcggccccttagctgcctggagctcccatctgaaggtgcagaagggtctggatcccggagtcgtcttagtctgccccccagagaaccccaggttcctgaccccctgttgtcctctcagcgcaggtcatatgcatttgaaacacaggctaaccctgggaaaggtgaaggactgtgattaggaccacagccctgggcaaaggggaccagcaagttgtcttgaatctccagggttcctgactagctgtctcctctgcagcatgagcagctgtagtgcccaactctataggctttggccctccagcttctctctttgactgtgggaggcactgccttggttggtttacctgaacttgtctccgacacaaagcacttatctcttaggagattcccaagaaagtcaacaagatcttgttcccagggagtgggtcattggccaaagggaacataaggtaggcagaaaacttaaaagagtttgttaaagtgaagactggagaaattcctcccttcctctgagctgtgaatctctcttcatgaaagccaaaggtagagacagggaggacagggccaggttagggccttccacacacaaacacttctagagttgcccattcctgttatgttcttggaccctaagatacctcctgtcccttttaaatccagattaagagaaacgtccaggaagagctctttgaagccctcaatatttgttggagggactggactcctctccagctccccaccctctgcctccagtcaccatgtgcaagagaggtcctgtacagatctctctgggctctcctttctcctttggaataacttgttcctatttcaggaaagggaaatggtgtcactcaggccctgggactgcttctccagccaggctggggccacaggtcccactctagtgaaggtcaatgtctcagaataaaagctgtattttta

SEQ ID NO: 175792 - DNA, 3887 bp, Homo sapiens
  Payload ID: 14518
  Gene Symbol: ARHGAP30
  Gene Name: Rho GTPase activating protein 30
  ENST ID: ENST00000368015
  CDS Start-End: 347-3121
gcaaagatgctctaacaggaagtgggttaaggagctgcactgcttcctgccccctaaagctgagcggggcgaggagggcgagtgccaggctgggccacgagacacaggacacaatttcttgccagggtcctggtagcttcctcttcaacagccacttccgtgtggccggggccccaggggcaggagctgctgcccgttgcccaggccaccctccacccccaattgggagccctgcccccctggggccgggccaagcccagcagctggctgggatcccatgggggactggtagggcacaggtcttgggggatagaggtgaccgggccagtgccctggggctctggccatgaagtctaaggacatagaggcctcaggcttcaatgggacagcggccttcatggaggtgcgggtacaatccatcgtcgtggagttcatcctcacacacgtggaccagctctttgggggtgctgccctctctggtggtgaggtggagagtgggtggcgatcgcttccagggacccgggcatcaggcagccccgaggaccttatgcccaggccactgccttatcacctgcctagcatactgcaggctggcgatggacccccacagatgcggccctaccatactatcatcgagattgcagagcacaagaggaaggggtctttgaaggtcaggaagtggaggtctatcttcaatttaggtcgctctggccatgagactaagcgtaaacttccacggggggctgaggacagggaggataaatccaacaaggggacactgcggccagccaaaagcatggactcactgagtgctgcagctggggccagtgatgagccagaggggctggtggggcccagcagcccccggccaagcccattgctgcctgagagcttggagaacgattctatagaggcagcagagggtgaacaggagcctgaggcagaagcactgggtggcacaaactctgaaccaggcacaccacgagctgggcggtcagccatccgggctgggggcagcagccgtgcagaacgctgtgctggtgtccacatctcagacccctacaatgtcaacctcccgctacacatcacctctatcctcagtgtgcccccgaacatcatctctaacgtttccttggccaggctcacccgtggccttgagtgccctgctctacagcaccggccaagccctgcctctggccctggccctggccctggccttggccctggccccccagatgaaaagttggaagcaagtccagcctcaagtcccctggcagactcaggcccagacgacttggctcctgccctggaggactcgctgtcccaggaggtgcaggactccttctccttcctagaggactcaagcagctcagaacctgagtgggtgggggcagaggatggggaggtggcccaggcagaagcagcaggagcagccttctcccctggggaggacgaccctgggatgggctacctggaggagctcctgggagttgggcctcaggtggaggagttctctgtggagccacccctggatgacctgtctctggatgaggcacagtttgtcttggcccccagctgctgttccctggactccgctggccccaggcctgaagttgaggaggaaaatggggaggaagttttcctgagtgcctatgatgacctaagtccccttctgggacctaaacccccaatctggaagggttcagggagtctggagggagaggcagcaggatgtggaaggcaggctctgggacagggtggggaagagcaggcatgctgggaagttggggaggacaagcaggctgagcctggaggcaggctagacatcagggaagaggcagagggaagtccagagaccaaggtggaggctggaaaggccagtgaggatagaggggaggctgggggaagccaagagacaaaagtcagattgagagaagggagtagggaagagacagaggccaaggaagagaagtccaaaggtcagaagaaggctgacagtatggaggctaaaggtgtggaggaaccaggaggagatgagtatacagatgagaaggaaaaagaaattgagagagaagaggatgaacaaagagaggaagcccaggtagaagctggaagggacctagagcaaggggcccaggaagatcaagttgctgaggagaaatgggaagttgtacagaaacaagaggctgagggagtcagagaggatgaggacaaaggacagagggagaaggggtaccatgaagcaagaaaagaccaaggagatggtgaagacagcagaagcccagaagcagcaactgaaggaggagcaggggaggtcagcaaggaacgggagagtggggatggagaggctgagggagaccagagggctggagggtactatttagaagaggacaccctctctgaaggttcaggtgtagcgtccctggaggttgactgtgccaaagagggcaatcctcactcttctgagatggaagaggtagccccacagccacctcagccagaggagatggagcctgaggggcagcccagtccagacggctgtctatgcccctgttctcttggcctgggtggcgtgggcatgcgtctagcttccactctggttcaggtccaacaggtccgctctgtgcctgtggtgccccccaagccacagtttgccaagatgcccagtgcaatgtgtagcaagattcatgtggcacctgcaaatccatgcccgaggcctggccggcttgatgggactcctggagaaagggcttgggggtcccgagcttctcgatcctcttggaggaatgggggtagtctttcctttgatgctgctgtggccctagcccgggaccgccaaaggactgaggctcaaggagttcggcgaacccagacctgtactgagggtggggattactgcctcatccccagaacctccccttgtagcatgatctctgcccattctcctcggccccttagctgcctggagctcccatctgaaggtgcagaagggtctggatcccggagtcgtcttagtctgccccccagagaaccccaggttcctgaccccctgttgtcctctcagcgcaggtcatatgcatttgaaacacaggctaaccctgggaaaggtgaaggactgtgattaggaccacagccctgggcaaaggggaccagcaagttgtcttgaatctccagggttcctgactagctgtctcctctgcagcatgagcagctgtagtgcccaactctataggctttggccctccagcttctctctttgactgtgggaggcactgccttggttggtttacctgaacttgtctccgacacaaagcacttatctcttaggagattcccaagaaagtcaacaagatcttgttcccagggagtgggtcattggccaaagggaacataaggtaggcagaaaacttaaaagagtttgttaaagtgaagactggagaaattcctcccttcctctgagctgtgaatctctcttcatgaaagccaaaggtagagacagggaggacagggccaggttagggccttccacacacaaacacttctagagttgcccattcctgttatgttcttggaccctaagatacctcctgtcccttttaaatccagattaagagaaacgtccaggaagagctctttgaagccctcaatatttgttggagggactggactcctctccagctccccaccctctgcctccagtcaccatgtgcaagagaggtcctgtacagatctctctgggctctcctttctcctttggaataacttgttcctatttcaggaaagggaaatggtgtcactcaggccctgggactgcttctccagccaggctggggccacaggtcccactctagtgaaggtcaatgtctcagaataaaagctgtattttt

SEQ ID NO: 175793 - DNA, 3482 bp, Homo sapiens
  Payload ID: 14518
  Gene Symbol: ARHGAP30
  Gene Name: Rho GTPase activating protein 30
  ENST ID: ENST00000368016
  CDS Start-End: 43-2715
gggggatagaggtgaccgggccagtgccctggggctctggccatgaagtctcggcagaaaggaaagaagaagggcagcgcaaaggagcgggtttttgggtgcgacttgcaggagcacctgcagcactcaggccaggaggtgccccaggtgctaaagagctgtgcagaatttgtggaggagtatggagtggtggatgggatctaccgcctctcaggggtctcctccaacatccagaagcttcggcaggaatttgagtcagagcggaagccagacctgcgtcgggatgtttacctccaagacattcactgcgtctcctccctgtgcaaggcctatttcagagaactgccggatcccctgctcacttaccggctctatgacaagtttgctgaggctgtaggagtgcaattggaacctgagcgcttggtcaagatcctagaggtgcttcgggaactccctgtcccaaactacaggaccctggagttcctcatgaggcacttggtacacatggcctcattcagtgcccagaccaacatgcatgctcgcaacctggccatcgtgtgggctcccaacctgctgaggtctaaggacatagaggcctcaggcttcaatgggacagcggccttcatggaggtgcgggtacaatccatcgtcgtggagttcatcctcacacacgtggaccagctctttgggggtgctgccctctctggtggtgaggtggagagtgggtggcgatcgcttccagggacccgggcatcaggcagccccgaggaccttatgcccaggccactgccttatcacctgcctagcatactgcaggctggcgatggacccccacagatgcggccctaccatactatcatcgagattgcagagcacaagaggaaggggtctttgaaggtcaggaagtggaggtctatcttcaatttaggtcgctctggccatgagactaagcgtaaacttccacggggggctgaggacagggaggataaatccaacaaggggacactgcggccagccaaaagcatggactcactgagtgctgcagctggggccagtgatgagccagaggggctggtggggcccagcagcccccggccaagcccattgctgcctgagagcttggagaacgattctatagaggcagcagagggtgaacaggagcctgaggcagaagcactgggtggcacaaactctgaaccaggcacaccacgagctgggcggtcagccatccgggctgggggcagcagccgtgcagaacgctgtgctggtgtccacatctcagacccctacaatgtcaacctcccgctacacatcacctctatcctcagtgtgcccccgaacatcatctctaacgtttccttggccaggctcacccgtggccttgagtgccctgctctacagcaccggccaagccctgcctctggccctggccctggccctggccttggccctggccccccagatgaaaagttggaagcaagtccagcctcaagtcccctggcagactcaggcccagacgacttggctcctgccctggaggactcgctgtcccaggaggtgcaggactccttctccttcctagaggactcaagcagctcagaacctgagtgggtgggggcagaggatggggaggtggcccaggcagaagcagcaggagcagccttctcccctggggaggacgaccctgggatgggctacctggaggagctcctgggagttgggcctcaggtggaggagttctctgtggagccacccctggatgacctgtctctggatgaggcacagtttgtcttggcccccagctgctgttccctggactccgctggccccaggcctgaagttgaggaggaaaatggggaggaagttttcctgagtgcctatgatgacctaagtccccttctgggacctaaacccccaatctggaagggttcagggagtctggagggagaggcagcaggatgtggaaggcaggctctgggacagggtggggaagagcaggcatgctgggaagttggggaggacaagcaggctgagcctggaggcaggctagacatcagggaagaggcagagggaaccccacagccacctcagccagaggagatggagcctgaggggcagcccagtccagacggctgtctatgcccctgttctcttggcctgggtggcgtgggcatgcgtctagcttccactctggttcaggtccaacaggtccgctctgtgcctgtggtgccccccaagccacagtttgccaagatgcccagtgcaatgtgtagcaagattcatgtggcacctgcaaatccatgcccgaggcctggccggcttgatgggactcctggagaaagggcttgggggtcccgagcttctcgatcctcttggaggaatgggggtagtctttcctttgatgctgctgtggccctagcccgggaccgccaaaggactgaggctcaaggagttcggcgaacccagacctgtactgagggtggggattactgcctcatccccagaacctccccttgtagcatgatctctgcccattctcctcggccccttagctgcctggagctcccatctgaaggtgcagaagggtctggatcccggagtcgtcttagtctgccccccagagaaccccaggttcctgaccccctgttgtcctctcagcgcaggtcatatgcatttgaaacacaggctaaccctgggaaaggtgaaggactgtgattaggaccacagccctgggcaaaggggaccagcaagttgtcttgaatctccagggttcctgactagctgtctcctctgcagcatgagcagctgtagtgcccaactctataggctttggccctccagcttctctctttgactgtgggaggcactgccttggttggtttacctgaacttgtctccgacacaaagcacttatctcttaggagattcccaagaaagtcaacaagatcttgttcccagggagtgggtcattggccaaagggaacataaggtaggcagaaaacttaaaagagtttgttaaagtgaagactggagaaattcctcccttcctctgagctgtgaatctctcttcatgaaagccaaaggtagagacagggaggacagggccaggttagggccttccacacacaaacacttctagagttgcccattcctgttatgttcttggaccctaagatacctcctgtcccttttaaatccagattaagagaaacgtccaggaagagctctttgaagccctcaatatttgttggagggactggactcctctccagctccccaccctctgcctccagtcaccatgtgcaagagaggtcctgtacagatctctctgggctctcctttctcctttggaataacttgttcctatttcaggaaagggaaatggtgtcactcaggccctgggactgcttctccagccaggctggggccacaggtcccactctagtgaaggtcaatgtctcagaataaaagctgtattttta

SEQ ID NO: 175794 - DNA, 560 bp, Homo sapiens
  Payload ID: 14518
  Gene Symbol: ARHGAP30
  Gene Name: Rho GTPase activating protein 30
  ENST ID: ENST00000368018
  CDS Start-End: 52-243
acaggtcttgggggatagaggtgaccgggccagtgccctggggctctggccatgaagtctcggcagaaaggaaagaagaagggcagcgcaaaggagcgggtttttgggtgcgacttgcaggagcacctgcagcactcaggccaggaggggtctcactctgttacccagcaggccagagtgcggcttcctgcagcccttgcctcctgggctcaggtgatcctcccatatcagcctcctgagtagctgaaactacagtgccccaggtgctaaagagctgtgcagaatttgtggaggagtatggagtggtggatgggatctaccgcctctcaggggtctcctccaacatccagaagcttcggaggctgtaggagtgcaattggaacctgagcgcttggtcaagatcctagaggtgcttcgggaactccctgtcccaaactacaggaccctggagttcctcatgaggcacttggtacacatggcctcattcagtgcccagaccaacatgcatgctcgcaacctggccatcgtgtgggctcccaacctgctgaggtctaaggaca

SEQ ID NO: 175795 - DNA, 2265 bp, Homo sapiens
  Payload ID: 14518
  Gene Symbol: ARHGAP30
  Gene Name: Rho GTPase activating protein 30
  ENST ID: ENST00000490279
  CDS Start-End: 180-389
ggggccccaggggcaggagctgctgcccgttgcccaggccaccctccacccccaattgggagccctgcccccctggggccgggccaagcccagcagctggctgggatcccatgggggactggtagggcacaggtcttgggggatagaggtgaccgggccagtgccctggggctctggccatgaagtctcggcagaaaggaaagaagaagggcagcgcaaaggagcgggtttttgggtgcgacttgcaggagcacctgcagcactcaggccaggaggtgccccaggtgctaaagagctgtgcagaatttgtggaggagtatggagtggtggatgggatctaccgcctctcaggggtctcctccaacatccagaagcttcggaggctgtaggagtgcaattggaacctgagcgcttggtcaagatcctagaggtgcttcgggaactccctgtcccaaactacaggaccctggagttcctcatgaggcacttggtacacatggcctcattcagtgcccagaccaacatgcatgctcgcaacctggccatcgtgtgggctcccaacctgctgaggtctaaggacatagaggcctcaggcttcaatgggacagcggccttcatggaggtgcgggtacaatccatcgtcgtggagttcatcctcacacacgtggaccagctctttgggggtgctgccctctctggtggtgaggtggagagtgggtggcgatcgcttccagggacccgggcatcaggcagccccgaggaccttatgcccaggccactgccttatcacctgcctagcatactgcaggctggcgatggacccccacagatgcggccctaccatactatcatcgagattgcagagcacaagaggaaggggtctttgaaggtcaggaagtggaggtctatcttcaatttaggtcgctctggccatgagactaagcgtaaacttccacggggggctgaggacagggaggataaatccaacaaggggacactgcggccagccaaaagcatggactcactgagtgctgcagctggggccagtgatgagccagaggggctggtggggcccagcagcccccggccaagcccattgctgcctgagagcttggagaacgattctatagaggcagcagagggtgaacaggagcctgaggcagaagcactgggtggcacaaactctgaaccaggcacaccacgagctgggcggtcagccatccgggctgggggcagcagccgtgcagaacgctgtgctggtgtccacatctcagacccctacaatgtcaacctcccgctacacatcacctctatcctcagtgtgcccccgaacatcatctctaacgtttccttggccaggctcacccgtggccttgagtgccctgctctacagcaccggccaagccctgcctctggccctggccctggccctggccttggccctggccccccagatgaaaagttggaagcaagtccagcctcaagtcccctggcagactcaggcccagacgacttggctcctgccctggaggactcgctgtcccaggaggtgcaggactccttctccttcctagaggactcaagcagctcagaacctgagtgggtgggggcagaggatggggaggtggcccaggcagaagcagcaggagcagccttctcccctggggaggacgaccctgggatgggctacctggaggagctcctgggagttgggcctcaggtggaggagttctctgtggagccacccctggatgacctgtctctggatgaggcacagtttgtcttggcccccagctgctgttccctggactccgctggccccaggcctgaagttgaggaggaaaatggggaggaagttttcctgagtgcctatgatgacctaagtccccttctgggacctaaacccccaatctggaagggttcagggagtctggagggagaggcagcaggatgtggaaggcaggctctgggacagggtggggaagagcaggcatgctgggaagttggggaggacaagcaggctgagcctggaggcaggctagacatcagggaagaggcagagggaagtccagagaccaaggtggaggctggaaaggccagtgaggatagaggggaggctgggggaagccaagagacaaaagtcagattgagagaagggagtagggaagagacagaggccaaggaagagaagtccaaaggtcagaagaaggctgacagtatggaggctaaaggtgtggaggaaccaggaggagatgagtatacaga

SEQ ID NO: 175796 - DNA, 543 bp, Homo sapiens
  Payload ID: 14518
  Gene Symbol: ARHGAP30
  Gene Name: Rho GTPase activating protein 30
  ENST ID: ENST00000471492
  CDS Start-End: 292-417
aaagctgagcggggcgaggagggcgagtgccaggctgggccacgagacacaggacacaatttcttgccagggtcctggtagcttcctcttcaacagccacttccgtgtggccggggccccaggggcaggagctgctgcccgttgcccaggccaccctccacccccaattgggagccctgcccccctggggccgggccaagcccagcagctggctgggatcccatgggggactggtagggcacaggtcttgggggatagaggtgaccgggccagtgccctggggctctggccatgaagtctcggcagaaaggaaagaagaagggcagcgcaaaggagcgggtttttgggtgcgacttgcaggagcacctgcagcactcaggccaggagggaggctgtaggagtgcaattggaacctgagcgcttggtcaagatcctagaggtgcttcgggaactccctgtcccaaactacaggaccctggagttcctcatgaggcacttggtacacatggcctcattcagtgcccagaccaacatgcatgctcg

SEQ ID NO: 175797 - DNA, 9317 bp, Homo sapiens
  Payload ID: 14519
  Gene Symbol: ARHGAP31
  Gene Name: Rho GTPase activating protein 31
  Uniprot ID: Q2M1Z3
  ENST ID: ENST00000264245
  CDS Start-End: 533-4867
ggaaaaaaaggaaggcgtgagggcgggcagcagcgacaggatgcttgtttttcgctctaccaaagtcgtctgaaggcgagacagcgggcccagggcgcaggacccaccgcagccccctgggcagtctcctcgccccgcgtccgcgtcgtctccggggcacttagtaaggggtggggagagcttgccctccctcttaagctgaggagaaacacccgaagacaccgcaggagcctgtgaaagtccctaggactccaagtgaggaagtgacactcccaggcgagccggcccgcggctgccagtctgcacggcctcggcacggcggccccggagcggcgcggggtggatctcaggctctgccggcccgcggcccgcggggtccatgcgcagggcccccagcccaagttcttccatcttccgatgcggccccccagagccgcggggcagccggtgatctagcccgggagcccatcttacagcggtgccaagcagaggggcggcagagacggaggggcagcctctttgggactaactcatgaagaacaagggtgctaagcagaagctgaaacgaaagggagccgccagcgcgtttggctgtgacctgacggagtatctggaaagctcgggacaggatgttccatacgttttgaagagctgtgcagaatttatagagactcacggcatcgtggatggaatctatcggctttcaggagtcacctcaaacatacaacggctaaggcaagagtttggctcagatcaatgtccagatctgacaagggaagtgtacctccaggacatccactgtgtgggctcgctttgcaagctctactttagggagctgcccaaccccctcctgacttatgagctctatgagaaattcacggaggcagtgtcgcattgccctgaagaaggccaactggcccgaatccaaaatgttatccaggagcttcctccatcccactataggaccttggaatacctgattcgacacctggcccatatcgcctccttcagcagcaagaccaacatgcacgcccggaacctggccctggtgtgggcgccaaacctcctcaggtctaaagaaattgaagccactggttgcaatggagatgcagccttccttgcagtccgggtccagcaggtggtgattgagttcatattgaatcatgtagatcaaatctttaacaacggtgcacctgggtctctggagaatgatgaaaaccggcccatcatgaagagcctgaccttgccagccctctccctgcccatgaagctggtgagccttgaggaagctcaagcccgcagcctggccactaaccatcctgctcgcaaggaaaggagggagaacagcctgcctgagattgtccctcccatgggcaccctcttccacactgtccttgagttaccagacaacaagcgaaagctctccagtaaatcaaagaagtggaaatcaatatttaacctgggacgttctggatcagactccaaatcaaaactgagtagaaatgggagtgtatttgtgagaggacagaggctctcggtggaaaaggctactatccgaccagctaaaagcatggactcactatgttcagtgcctgtggaaggaaaagaaaccaagggaaatttcaatcgaacagttaccaccggtggatttttcattccagcaacaaagatgcactccaccggcaccggcagctcatgtgacctcaccaagcaggagggcgaatggggccaggaggggatgcctcccggggctgagggtggctttgatgtgagcagtgatcgcagccatctccagggcgctcaggcccggcccccaccggaacagctgaaggttttccggcctgttgaggatccggagagcgagcaaacagccccaaagatgttgggtatgttctacacttcgaacgacagccctagcaaatccgtcttcaccagcagcctcttccagatggagccctcgccgcgtaaccagcgcaaggcgctgaacatctccgagccctttgcggtatctgtgccgctccgcgtgtccgcagtcatcagcaccaacagcacgccgtgcagaacacccccgaaggagctgcagtctctttccagcctggaagagttttcttttcatggatcagagagcggaggctggccagaagaagagaaaccgctgggagctgagacttctgcagcttctgtacctaagaaggcaggtcttgaggatgccaaggcagtacctgaagcaccggggacagtggaatgcagcaaaggcctgtcccaggagccaggcgcccacctggaggagaagaaaaccccagaaagctccttgagctctcaacatttaaatgaattagagaagaggccaaatccggagaaggtggtggaggagggacgagaggctggtgagatggagtccagcaccctgcaggagagccccagggccagagccgaagctgtgcttctccatgagatggatgaagatgatctggccaatgccctgatctggcctgagattcaacaggagctgaaaatcattgaatctgaggaggagctctcatcgttgccacctcctgctctgaagaccagcccaattcagcctattctcgagtcgagtctggggccctttattccctcagagcctcctgggagcttgccttgtggctccttccctgctccagtctccacccctctggaggtgtggactagggatccagccaatcagagcacacagggggcttccacagcagccagcagagagaagccggaacctgagcagggcctgcacccagacctcgccagcctggctcctctggaaatagttccttttgagaaggcatctccacaagcaacagtggaagtaggaggcccaggcaatctgtctcctccactcccacctgctcctccccctccaactcctctggaggagtcaactccagtcctgctttcaaagggcggcccggaaagagaagactcatccaggaaattgaggacagatctctacatagaccagctgaagtcccaagacagccctgagatctctagcctctgtcagggagaggaggcaaccccaagacacagtgacaagcaaaattcaaagaatgctgcttctgaggggaaaggctgtggttttccaagcccaaccagggaggttgagatcgtctcacaagaagaggaggatgtaacccattcagtacaggagccttcagactgtgacgaagatgacactgtgacagacattgcccagcatggcctggagatggtggagccctgggaggaaccccagtgggtgacgagtccccttcactctcccaccctgaaagacgcgcacaaggcccaggtacagggccttcagggtcaccagttggagaagaggctttcccacaggcccagccttcgccagagccattctctagatagcaaacccacggttaaaagccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagcagaaaccagccccatcagcctagcagagggaaaggagctagggacacacctggggcacagcagtccacagattaggcaaggtggtgttcctgggccagagagcagcaaggagagttcacccagcgtgcaggacagcacttcgcctggagagcaccccgcaaagttacagctaaagagcacagagtgtgggcccccaaaagggaaaaacaggccttcttccctcaacttggaccctgccattcccattgctgacctcttctggtttgagaatgtggcctcatttagttcacctggaatgcaggtctctgagccaggagacccaaaggtcacatggatgacctcatcttactgtaaagcagacccctggagggtttactcccaggacccccaggacctggacattgttgctcatgcactgacaggccgccgtaactcagctcctgtgagtgtgtcagctgtgagaacctccttcatggtcaaaatgtgccaggccagggcggtcccagtcatccctcccaagattcagtacacccagatcccacagcccctgccctctcagagctcaggggagaatggggttcagcctctggagaggagccaggagggacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacctcagagcctaatcttattcagtcctcctttccccattatggaccacctgcccccttcatccacagtgacagattccaaggtcctgctgtcccctatcagaagtcccacccagacagtttcccctggccttctttgtggagagttggcagaaaacacatgggtcacaccagaaggggttacacttaggaataaaatgaccatccctaagaatggccagagactagagacctcaaccagctgtttttaccagcctcagcggagatcagtaattctggatggaagaagtgggaggcaaatagaatgatttcggttcacctgctggtgtctgaaaaaaaccgtgattcatctggaagttattacagggccagcttgccatattccaggcacacgttatcaagtttgggcctattgtggcctctgacttctctttcttcagccttttgaccacttattaattagtccatttgctagaagagtggtcaagggaaaaacgagagatgaaatttagttaagtctatgtgagcaagtgagagaaggttaggtaaggggagaggatggaatgcttgcctccaatgaactttggagcttgtatgtgagtcagattgctcccctattgctattatctattactcttgagagctggctgtcctttgaaagaaagaagtaatgttctttgaaagaaagaaaaatctcttgctgtgtcaaacctcaaaatgttgctattggggttagaaggcctcctctttatgctttttaatgctctttcaaacgtgttcttttagaccagttttctaataagctttgtaaaatgtactatccaaattagaagcggatttggaaatgcaaactaacgtgcacttagatatccaagtgggtgagcttagccactcttacccatgctctttccctggaatccctggagacctgtccaagatgatttccatataccagcatagaaaatcagaatcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaattgtgaagtgaaggcatctgctttctttacagtatcagagtccaagaacaggatgtcaccatagataaaagcctcatacaaaggcagaactacactccaaatttaatgtgtttaaattggtggggcaccagcagaaaatattctagctcagctttactcttcttccacactaggctgggcccagcaatacaggagaggatgaagggaggagctccaggaggcgagggaagagccctagcagggcggccatcacaaccactcactgagagttgcccttcttaaaaatgtattttattttagccagtgggtcccttcctttctcctttcctctctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaattatttataactttcaatggttctttcctttccagctggcgagagaaaggagaactaatatacctgctggcagatttttggtgctgcccaaaaaaggacttcacagggcatctcttctcaggttcaagcctggctgaattctgcccagaagctcagtcattgcagaaatttctctaagggctgatagtacctctgggtaggcgtcacaaccaaggctggttctgggcttagtgggggctgagatgaagttacctcctccaatgagaaattgggagctgatgccctgcaacagatatatattcctctctctctctgtctctctatctctctcctccctctccctccctccctccccgccaataagccttacaaacagttttgaaatcttgttctgtaccttttaagccagtgtctgtggcgagggtgactggcaagtcagctgatgagttctgccttctgagagcactgagtgagcaaggcctttcatcagtgttttggccttctcattgggtgaggaagacattgaaccaacagccaacgagatatgaacctgtaagaaaaaagtcctagaatatagtatttttccccaggccagcaaagtgaagaaatacagtggtgacagatgagaaaggccatgttcaagagatctgaaaagtacattcctgccttatcagaaaatgtgtcagacaggttttatgtcagcctcagtgctcctgcggtgtcgacgctctgataaggaccatgttccagttagaatgcgagggagggaaagagctgcactttgcttcaccatcagaactctgagccaaataatgaatatgtaaactattttatgattattttaaatgtttgtttggtaacatttataagatctatttttatttggggatagactgagaagccaccatttacatattaacaagtgacttcagttctaagggttgagatgcctgtgtggatttataaaatggttgcaagatcttttagactctgacatttatagcatcaccttcaggaacacagttctggggatgtcatcatgagacacactgacagctgtggagatagtccctactctcagctttccttgctagtcaagtccaaaaggccttagaagctgactcaccttctcagccagagtcctgctgctcaagtgtggacctccactttgactctcacccagcctgccagccatcacaaaggctttcataaacttcctgtggtctgggctagcctggcactgatgaaattccattctaaagaaagaaaactcatattcctcccccccacaaattgttcccccaaatgctctgggattacctatttcaccactcatttgagtctccgaaaaatgaactccctgagaatggctggatgggaatcagatagtctgcttccattcaggagagggacagaacaggagctgctgtgtttaggaggatttacctggtgccctagaaagggctatgcaatcaaattctcaagggctccttcaaatcagctatcagtcctcaaaatgggggttgctgatgttaaatgatggatttgcagtgaaacgcatgcatgtactgacgttttctttcagcattagtggttgcttaagaaaatagtaacctatattttctgctacacttggaatatgaagaaatctgaacaagaaccccattaagacacctaacctaatctaaaccctaaaattcaaaatattgtccaagtcaaaagtctagactctgaggacattaaaaatgtaaatatcatcatccttagcaaatatttattgggagcttagtaatagtgcactgggtaccttagcactcccaaatcattcaagagtctagtgaaaaagggggagggatggcagcaaataaaacacccccataaacaaccaggagcaaggttgagaaccattaagttgccaaacaaaagcagaaggggaaaaagtgtggcaacaagcatcttttaataggatagttgacggtattcaagtgacctactgactccaaataatcaaattgaacacaattgcaaatccaatagaacatcccagtgagacactcgggtatttgagaactttgcttgatttagaaaactggaaagtggcaactaggctagaatagtggcaactaggttcggaggtttcgtgtggtcataattggtttggtgaagtgtgagatctctgcaaatgagccaggtaagatcagtattccatagtgcttgaaaaggggattttagagacttctgtcatcacaaagcagattaactcctagttaatgatgaagcagtaggcccaagataaactgttcaattcaagataaattgttcttgtcagtgtttggcatatgataatcacatttggctaaaattggatgggacagtcatttgtctacacaggccttccattcctgcatgaagagatactggggagcatacaattattttgtccagtattagagtgggagaagttctcagtaagtccagtcccaccaggatttatttgggccacattctaccacggccagtccaatctgatgaccacatgaattggggttaagtgttgctaagactatgattttagacatgtctggcaggaaggtcagctcaaaatgtggcatgacaaagaatatgtgctctactaccaaaacctttcctagcaaaacaaggccagaagagggagcaagcatctttccaagcatggagaggagggggcaatggtggaagggtgattgcctgaaatcagtgccagtacagatagcataaaattgggggccaccacagattggctggctactgtgtagatcatttagtaatcttgaggtacattaataatgcagagattacttttctgtgagggtaagggggacgtagctaaatataagaagcttacaaggtccatagccatgtattttactggataaatcacaatgctttgcaataacttaatgtcatagtactttctggcttataattctgcaaagtaaagcactttttcaaagga

SEQ ID NO: 175798 - DNA, 551 bp, Homo sapiens
  Payload ID: 14519
  Gene Symbol: ARHGAP31
  Gene Name: Rho GTPase activating protein 31
  ENST ID: ENST00000482743
  CDS Start-End: 55-551
gcagatcagcggaatggctaaatgaaggtgctatactttacttaaaaggtgaaaatgtgtcatttggttccatacgttttgaagagctgtgcagaatttatagagactcacggcatcgtggatggaatctatcggctttcaggagtcacctcaaacatacaacggctaaggcaagagtttggctcagatcaatgtccagatctgacaagggaagtgtacctccaggacatccactgtgtgggctcgctttgcaagctctactttagggagctgcccaaccccctcctgacttatgagctctatgagaaattcacggaggcagtgtcgcattgccctgaagaaggccaactggcccgaatccaaaatgttatccaggagcttcctccatcccactataggaccttggaatacctgattcgacacctggcccatatcgcctccttcagcagcaagaccaacatgcacgcccggaacctggccctggtgtgggcgccaaacctcctcaggtctaaagaaattgaagccactggttgcaatggagatgcagcctt

SEQ ID NO: 175799 - DNA, 10111 bp, Homo sapiens
  Payload ID: 14520
  Gene Symbol: ARHGAP32
  Gene Name: Rho GTPase activating protein 32
  Uniprot ID: A7KAX9
  ENST ID: ENST00000310343
  CDS Start-End: 1-6264
atggagactgaaagtgagagtagcactttaggggatgacagtgtcttctggttggagtctgaagttataatccaggtgactgactgtgaagaggaagaaagggaagagaagttcaggaagatgaagtcctcagtacattctgaagaagatgattttgttccagagctacatagaaatgtacaccctcgagagcggcctgattgggaagaaactcttagcgcaatggcaagaggcgcagatgttccagagattcctggagatcttactcttaagacgtgtggcagtacagccagtatgaaggttaagcatgtgaaaaagttacccttcactaaaggtcactttccgaagatggctgaatgtgcgcatttccattatgagaatgttgagttcggcagcatacagctttcactttcagaagaacagaatgaagtaatgaaaaatggctgtgaatctaaagagctggtctacctcgtgcagattgcttgtcagggaaaaagttggattgttaaaagaagttatgaagattttcgggtacttgataaacatcttcatctgtgtatttatgaccgaagattttcccagctctcagaacttccccgttctgacaccctgaaggacagtccagagtcggtcactcagatgcttatggcttacctgtcacgcctttcagctatcgctggcaacaagatcaactgtgggcccgcccttacctggatggagattgataataagggaaatcaccttttggttcatgaggagtcatccatcaacactcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaaaaaaaaaaaagcccagcatggtttgactggatagacacgcataatttattatgaatataaatttccatgtttgtttctgttcctaaaccagagtacgaggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttgtaattaccatctacaccagcatttcaggtatagctctttataactctggagacatgtaaaacatgtttaacacccacgagttttgaaagttgcattccttattagagtaggaactctctagcccaactccattctatgttctcagctccctccaccccccaaaatacatcagactagcaaggcagtcctatgtttacaaaacgagtttagattgtcatttcattccataactcttaataatactcaagttttatacattcacgtattttaaatgctcggtctgtagaagacactaggagaattgcattccaattactggatggttgctgctctggctttttagaacttgaaattaatttttatttagagcaaaggaggaaatcttttaagaggctaaaatcatgctgctattattgctgtgaaattgtataaagattaggattcatgccagtttttattttaaaaaataatgtgcattttaagggtttatatttagaaaaaaataaaatgtttcaagaacaacacattgatatgtggaaatattctataaggttttcttttgttcccttagaattcattggagggatgcagtaaaaactgtagtagaaaccttgaaacacccatatgtgaaaaggtctgtggaaattgaggcctctacattaaaagtgcagaaccaactgttttacagtcaaagtgctaggaaacctgataggatacttccctttggcacaaaaacaccctgggtgctacatacaggagtatgacctttggtgaatatgtggcactaattttttttaccttaatcatattcttgtcaagtaggcaacccattgccccttggagaccacaccagccctgtaagttctcaccagcagcatggagattaggaagaggggctgctgtgaccaggagatacacacggctttaagtaactgagagcctaaagaaagtaacccagggagtccggtccagttttaatatttgtggatttgttgtcacacacattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggtctgattgaaataaatattccctggacgtctggctaaaaattttgctaacaatcccagaggtgccattttcttattaataaatttcattggagccttatttcttactatattcaatttcgtttcaaacctgcaagtccctgggatggtcccacgactagggcctgcacatttcttacaatggcaaagcattttttaaaatttagggtcaggttgaaaaattctaggactaattctgtagagaggagggactgttaactaacgtgagtggggacggaggagtaggttaccacatttggagcagtaatagatgcaaacgatgtaaatttgaaatttgcccctttagttaaagaaggagcctgcaaagtccatttctctgttttcagccctgtcagtcacccatttaggatgttggcaaagtactgcttgagcagaatgtgtaagaaagtaataatgaaagcaaaagtatgtcagacagttacttcttccacatggttagaggcatgtgattttcagcactgtgtgttacagaaatgtcaggaatggtgtattataacgtgtgcaagataatgtcagtgtgcacagagggtcttttttccttatctgattagtactgttaatgttcaaagaataaaaatggttttacagtttagattctgagatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcatttcttgcaaacttatttgaagctgagttgtgggtttgggttttgtttgtttctttggttgcagggtggggtggggggtggcaggggagggaggaagggatttttgtacctggagatggagatatcttgtggtttaaagcaaatgtcccactgaaagtgattcaaatatcaacagaattatttcaggttaaaacaga

SEQ ID NO: 175800 - DNA, 6556 bp, Homo sapiens
  Payload ID: 14520
  Gene Symbol: ARHGAP32
  Gene Name: Rho GTPase activating protein 32
  Uniprot ID: A7KAX9
  ENST ID: ENST00000392657
  CDS Start-End: 380-5596
aaagcagtatgtgctgagagaggaggattaagctcctggaggcagagctctcccacacacttgctggcttgctgggctccactgactggactgaaaacagggccaagaaaactgctgctgcagggggtcctgaaaacagctggaacccggcagtgatgtgggacctaacttgaagttaacctgtggtggtgaggttggaaccagttggattatgatttattttctacactcttgtacggaatgcagagctgttgtatcctgatgaatctactgctaaatatagtcatttggaataattttaagtattgatcttaaaacttgtaccacaacaagagtgtctaaaaagcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcatt

SEQ ID NO: 175801 - DNA, 719 bp, Homo sapiens
  Payload ID: 14520
  Gene Symbol: ARHGAP32
  Gene Name: Rho GTPase activating protein 32
  ENST ID: ENST00000525234
  CDS Start-End: 184-719
gcccggccgagcccccgcggctgccctcggcggccaggcgctaggctcggcggcgcgggcggcgctcggcggcggcggcggcgggcggagggcgtcgggcccggcccgcggagggcagacacggagcggccagcggggcgcagggacgccgcggcggcgcggcggggccgcggggctcggaagatgaagtcctcagtacattctgaagaagatgattttgttccagagctacatagaaatgtacaccctcgagagcggcctgattgggaagaaactcttagcgcaatggcaagaggcgcagatgttccagagattcctggagatcttactcttaagacgtgtggcagtacagccagtatgaaggttaagcatgtgaaaaagtccaccactccaggactgatgggctgtgacaacattcacaggttacccttcactaaaggtcactttccgaagatggctgaatgtgcgcatttccattatgagaatgttgagttcggcagcatacagctttcactttcagaagaacagaatgaagtaatgaaaaatggctgtgaatctaaagagctggtctacctcgtgcagattgcttgtcagggaaaaagttggattgttaaaagaagttatgaagattttcgggtacttgataaacatcttcatctgtgtatttatgaccgaagattttcccagctctcagaacttccccgttctgacaccctgaa

SEQ ID NO: 175802 - DNA, 8194 bp, Homo sapiens
  Payload ID: 14520
  Gene Symbol: ARHGAP32
  Gene Name: Rho GTPase activating protein 32
  ENST ID: ENST00000524655
  CDS Start-End: 25-2865
gattgggaagaaactcttagcgcaatggcaagaggcgcagatgttccagagattcctggagatcttactcttaagacgtgtggcagtacagccagtatgaaggttaagcatgtgaaaaagttacccttcactaaaggtcactttccgaagatggctgaatgtgcgcatttccattatgagaatgttgagttcggcagcatacagctttcactttcagaagaacagaatgaagtaatgaaaaatggctgtgaatctaaagagctggtctacctcgtgcagattgcttgtcagggaaaaagttggattgttaaaagaagttatgaagattttcgggtacttgataaacatcttcatctgtgtatttatgaccgaagattttcccagctctcagaacttccccgttctgacaccctgaaggacagtccagagtcggtcactcagatgcttatggcttacctgtcacgcctttcagctatcgctggcaacaagatcaactgtgggcccgcccttacctggatggagattgataataagggaaatcaccttttggttcatgaggagtcatccatcaacactcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggtaccgtttgttttcctccattctttctttaagttaagagggatcttcaatcctgtgtgccatctgtgccttttaagagagaaatttgtccacagctagcctttaatcaaagagaatgcttttctgggtggtgctgatggctcagagccctaaattaaaagcagtccaacaaaactccccaaaagggccaatggtcctgcttcaaatcttcacaaaagtccccttatctctttggacggtgagaattcgtggataatttttgcacaactgcgtagctcttgattctgtttttctcttctaataaaatatctttattgtagccttccaagttaacaagccagctacaccatcaaatgtaaaaactgttcataataacagtctacaagcacttgaagcttgttttctaagcaatcttttctgagccaggtgagggacatgctttttttcccccccatctctgtaacaattcaagaagagattgcagtctttatacactgtttgttttagttttccttctgaaccagatgtgttttcaacagcatttgcatgtgggatagaagatcatggattgccattttgaaatatggaaggcacctattttttaatgatcacatggggagtgtttggctttccatttaggataacgtaagctaccttttcactctcattttttttcccaatttcccactaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggtaagaaggggaagatatcagtgagatgaaatatactattaccaaaggtatgtcacttttcagcagggtgtgttgttatctttgagtcagacacaacaattacttttaagccctgtggctggtttccatgagatagttcccatttgaggttggagtctgccattaccttgatgctggcttttccccaggaaaggagtagctcctagatgactatagcttaactgtacctgctcccttttcttcctaaagtgtctcggtagtttattccagtaacacaaagagatcaggatcaaatgagacaaagtgggctttacggttgtgggttgctttttcttatttttttccaactccatcactgactcattgtgactttgggcaagtcatttacctaccctctgccaattattcacagttacacaatgaaaatacttcattctcaaaacattcgtaagactgtctgccttgcagactttttggaagtataagagattatagtgccttgggattttttgttactttcctagcattcaccagcagtttgtcccatagtcaggtgcctgtttcaatgagagaatgtagtatgcagaatgctaaggtttcttcctgaatttcctcatattttaagaaagtgccacaggttgtttttcttctatatggtcaccttgaactattaataggacttaagattttagaccttagtggaggatgctgtgtttactgcttctcaaggatagcatgttttcagtatgaggattatctttggccagactaaggtggaatcaaaggtaggagagaggcagtagcttctgatttgaatattgcctttccctatgtttgaagccctaaaactgctaactgtgtacaactgtgaatttcaaaagtctccccagatgatagaattaactcttaatttaacaagatgtcctttgtgttgagactgagctagactaatagaccgggtatgtatttttaagctctacagcattacttgactaaacctctcttttggtttgtatattaaaattatgccataggcaacctcatctcgcatttaaaacctctcataaattagaaaactttgaatggttctccaaagataatactgggtgttgtacaaaatagcagcacaagccttcttttcctagaaatgggtacagattcattgcaaccacatggcttgggaaagttcaagctgctacccaaccagccttaatttgtgagttacaaatttaatagtacttgattcatagagggaacaaaaaatagacccatagtattatcatctttcaataggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagca

SEQ ID NO: 175803 - DNA, 5289 bp, Homo sapiens
  Payload ID: 14520
  Gene Symbol: ARHGAP32
  Gene Name: Rho GTPase activating protein 32
  Uniprot ID: A7KAX9
  ENST ID: ENST00000527272
  CDS Start-End: 35-5251
gcacggcaagctcattacgttcttacgaacattcatgaagtctcgtccaacaaaacagaagctgaagcagcggggaatcttgaaagagagggtgtttggttgtgacctgggggaacaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctgga

SEQ ID NO: 175804 - DNA, 2545 bp, Homo sapiens
  Payload ID: 14521
  Gene Symbol: ARHGAP33
  Gene Name: Rho GTPase activating protein 33
  ENST ID: ENST00000007510
  CDS Start-End: 58-2304
acgagaacggcgagcgaggggtcgagcgcggccggggcctgaggaggctacgcgaccatggtggcacgcagcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggag

SEQ ID NO: 175805 - DNA, 3858 bp, Homo sapiens
  Payload ID: 14521
  Gene Symbol: ARHGAP33
  Gene Name: Rho GTPase activating protein 33
  Uniprot ID: O14559
  ENST ID: ENST00000314737
  CDS Start-End: 85-3465
tgtgtcgccatggcggcggcagcggcgacgagaacggcgagcgaggggtcgagcgcggccggggcctgaggaggctacgcgaccatggtggcacgcagcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctgaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcccagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtg

SEQ ID NO: 175806 - DNA, 4219 bp, Homo sapiens
  Payload ID: 14521
  Gene Symbol: ARHGAP33
  Gene Name: Rho GTPase activating protein 33
  Uniprot ID: O14559
  ENST ID: ENST00000378944
  CDS Start-End: 455-3826
acgggcagccgttaggggcggggtctgcagccgcccgcgcgcggctcgcgccctcccctttgtgtcgccatggcggcggcagcggcgacgagaacggcgagcgaggggtcgagcgcggccggggcctgaggaggctacgcgaccatggtggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtg

SEQ ID NO: 175807 - DNA, 528 bp, Homo sapiens
  Payload ID: 14521
  Gene Symbol: ARHGAP33
  Gene Name: Rho GTPase activating protein 33
  ENST ID: ENST00000590893
  CDS Start-End: 117-413
agccgcccgcgcgcggctcgcgccctcccctttgtgtcgccatggcggcggcagcggcgacgagaacggcgagcgaggggtcgagcgcggccggggcctgaggaggctacgcgaccatggtggcacgcagcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagtgtgaaatcatcaaggcagcgggatagagaaatatttaaatactgatgctggtgccactgctgctgcagtacctggagacactgtcaggactggtggacagtaacctcaactgcgggcctgtgctcacctggatggagctgg

SEQ ID NO: 175808 - DNA, 2983 bp, Homo sapiens
  Payload ID: 14521
  Gene Symbol: ARHGAP33
  Gene Name: Rho GTPase activating protein 33
  ENST ID: ENST00000587447
  CDS Start-End: 1-2590
gcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcccagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtg

SEQ ID NO: 175809 - DNA, 2004 bp, Homo sapiens
  Payload ID: 14521
  Gene Symbol: ARHGAP33
  Gene Name: Rho GTPase activating protein 33
  ENST ID: ENST00000588248
  CDS Start-End: 1-1987
gcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggagcccccagcatgtcctgacctgtgcacggggatggggggacaactcctacccttctttccccacatgccccactaaaccatctgacaacatta

SEQ ID NO: 175810 - DNA, 8889 bp, Homo sapiens
  Payload ID: 14522
  Gene Symbol: ARHGAP35
  Gene Name: Rho GTPase activating protein 35
  Uniprot ID: Q9NRY4
  ENST ID: ENST00000404338
  CDS Start-End: 1-4500
atgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagcattacaaaagctccaagcagagcgtgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatgagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacactaattgagcatgtgcgtggggtgggggtgtgtgtgcacatgtgagtgtgagtgtgtgtgggcgcttggtggggggttggggacagctggaaggtgccaggtgcacttggggttggggttggtgtgttgggtgttgaagtggaatcgtttcatcccagccatggaggccaccagcaggagtgttcatggggatgtgggcgaggtggggcactttgaaggaatggcggtctgctggtgccctcgaaggggcatccttcctggtcttcgctgacccagaggcgctgtgcctgcatatcatccaccaccaccctagcccagccttcccactgccccaggaaaagctcttctcctggccacctctgccccccagcacctcaaacttgcatggctgggctgtggcctctgcggccaggaagcctgacactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacgcacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcggtgcggtcggtgcagcgtggccaatgcgcggcgcgcgcgggggacagagcaggaggcggtctgtcacctcggccactgctgacctgggctggcctcccccagccctcccgtggcggagccggcagcgatgctacaggcctaagttattgtttgcataaaaagaatcatgttccctgtgtacatttaagaaaaaaacaaaaaaacggaaatgtcagaattgtatggaaataaaacttgtttgaaaatttggaatagtgctgctgccagcttatttttctggtacttgtattttcacatgttaaatgatctttatatatgttgaattaacaaatattttgagtttctgagaaaaaacaaaacatattaatggtattgaaatgtgttagtagtctggctgtgtgcccaaaattctgtttcgcagcaaaagtgaagacctgtatgtaaagaaagtataacaattatttctttgtattttaggggctttaaccggaacatcgtctagctggtgttaggaatgtttgcttaatttccagacttttttttaaaaacacatcgtgggttttttgaggctccaacctgattagtgcatggtcagccctcaatgaaggctgaggcatctctgactgaggtgtttttgtttggttttgttttttaaaatcatgtatttgctacaaagtattgtacttgtctcaatgggaatggtgtaaaaaacaaaaggccttatgtgatctgtatcatagttaataaatgaatcttgtaaaaaaccaaa

SEQ ID NO: 175811 - DNA, 2713 bp, Homo sapiens
  Payload ID: 14522
  Gene Symbol: ARHGAP35
  Gene Name: Rho GTPase activating protein 35
  ENST ID: ENST00000615647
  CDS Start-End: 1-2250
atgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagcattacaaaagctccaagcagagcgtgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatgagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactag

SEQ ID NO: 175812 - DNA, 7696 bp, Homo sapiens
  Payload ID: 14522
  Gene Symbol: ARHGAP35
  Gene Name: Rho GTPase activating protein 35
  Uniprot ID: Q9NRY4
  ENST ID: ENST00000614079
  CDS Start-End: 1-4500
atgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagcattacaaaagctccaagcagagcgtgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatgagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacactaagcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacgcacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgc

SEQ ID NO: 175813 - DNA, 3083 bp, Homo sapiens
  Payload ID: 14523
  Gene Symbol: ARHGAP36
  Gene Name: Rho GTPase activating protein 36
  Uniprot ID: Q6ZRI8
  ENST ID: ENST00000276211
  CDS Start-End: 346-1989
atgctcgaggtgtccggtgaccgaaacactcttagctgggtgcagggtgcggctcagggcgtggtcaccgggggctacttagggccgccggtgcgggggacgacgcaaaggttaactgcgagctgccgggcactcagcgcgggtcatggcgtggatactggactgccttttcgcctcggcctttgagccccgcccccgccgtgcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagagctctgcctattgaccgtccgaacaccttggataagtggtttctgattttgagaggacagcagagggctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtgcgtcagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaactttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtgcctccccatattcagaggcaggttgctaagcgcgtgtggaagtccagcccggaagcacttgattttatcagacgcaggaacttgaggaagatccagagtgcacgcataaagatggaagaggatgcactactttctgatccagtggaaacctctgctgaagcccgggctgctgtccttgctcaaagcaagccttctgatgaaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagc

SEQ ID NO: 175814 - DNA, 2447 bp, Homo sapiens
  Payload ID: 14523
  Gene Symbol: ARHGAP36
  Gene Name: Rho GTPase activating protein 36
  Uniprot ID: Q6ZRI8
  ENST ID: ENST00000370921
  CDS Start-End: 114-1349
attctttctctcgtggctccccagctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtgcgtcagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaactttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtgcctccccatattcagaggcaggttgctaagcgcgtgtggaagtccagcccggaagcacttgattttatcagacgcaggaacttgaggaagatccagagtgcacgcataaagatggaagaggatgcactactttctgatccagtggaaacctctgctgaagcccgggctgctgtccttgctcaaagcaagccttctgatgaaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagcagca

SEQ ID NO: 175815 - DNA, 2736 bp, Homo sapiens
  Payload ID: 14523
  Gene Symbol: ARHGAP36
  Gene Name: Rho GTPase activating protein 36
  Uniprot ID: Q6ZRI8
  ENST ID: ENST00000370922
  CDS Start-End: 31-1638
ctgcgagctgccgggcactcagcgcgggtcatggcgtggatactggactgccttttcgcctcggcctttgagccccgcccccgccgtgtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagagctctgcctattgaccgtccgaacaccttggataagtggtttctgattttgagaggacagcagagggctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtgcgtcagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaactttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtgcctccccatattcagaggcaggttgctaagcgcgtgtggaagtccagcccggaagcacttgattttatcagacgcaggaacttgaggaagatccagagtgcacgcataaagatggaagaggatgcactactttctgatccagtggaaacctctgctgaagcccgggctgctgtccttgctcaaagcaagccttctgatgaaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagcagca

SEQ ID NO: 175816 - DNA, 2686 bp, Homo sapiens
  Payload ID: 14523
  Gene Symbol: ARHGAP36
  Gene Name: Rho GTPase activating protein 36
  Uniprot ID: Q6ZRI8
  ENST ID: ENST00000412432
  CDS Start-End: 38-1588
attgtatgctactggcaccttgagaaggttgaaagcaatgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagagctctgcctattgaccgtccgaacaccttggataagtggtttctgattttgagaggacagcagagggctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtgcgtcagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaactttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtgcctccccatattcagaggcaggttgctaagcgcgtgtggaagtccagcccggaagcacttgattttatcagacgcaggaacttgaggaagatccagagtgcacgcataaagatggaagaggatgcactactttctgatccagtggaaacctctgctgaagcccgggctgctgtccttgctcaaagcaagccttctgatgaaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagcagca

SEQ ID NO: 175817 - DNA, 728 bp, Homo sapiens
  Payload ID: 14523
  Gene Symbol: ARHGAP36
  Gene Name: Rho GTPase activating protein 36
  ENST ID: ENST00000423277
  CDS Start-End: 75-728
ccggaccaagaggctcgccaagagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagagctctgcctattgaccgtccgaacaccttggataagtggtttctgattttgagaggacagcagagggctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtg

SEQ ID NO: 175818 - DNA, 4697 bp, Homo sapiens
  Payload ID: 14524
  Gene Symbol: ARHGAP39
  Gene Name: Rho GTPase activating protein 39
  Uniprot ID: Q9C0H5
  ENST ID: ENST00000276826
  CDS Start-End: 203-3454
cacgggtgccgtggagtccatcgtcatcctgcccagccagtctgcggcggtgggctgggccgggtgattggtgtggtgaggcgtcttccatatcagcactgttgcttctcccctcttgcagtgcggcaccttcccgtctgatgctggcgttgtgcgtatggtgccctgacgtctgtccacgtgggcgcggaagcaaacagcgatgtcccagacgcaggactacgagtgcaggagccataatgtcgacctgccggagtcgaggattccagggtcgaacactcggttggagtgggtggagatcatcgaaccgcgcacccgcgagcgcatgtacgccaacctggtcaccggtgagtgcgtgtgggacccgccggccggcgtccgcatcaagcgcaccagcgagaaccagtggtgggagctgttcgaccccaacacgtcccgcttctactactacaatgccagcacgcagcgcacggtgtggcaccggccgcagggctgcgacatcatcccgctggccaagctgcagacgctgaagcagaacacggagtccccgcgcgcctcggcggagagcagccccgggcgcggcagcagcgtcagccgtgagggcagcaccagctcctccctggagcccgagcccgacactgagaaagcgcaggagttgccagcgagggccgggcggcccgcggcgtttgggacagtgaaggaggacagcggcagctcttcaccaccaggagtgttccttgagaaggactatgagatttaccgggattacagtgcggacggccagcttcttcactacaggacctcctcgctgcggtggaactcgggcgccaaagagcgcatgctcatcaaggtcgctgatcgggagcccagcttcctcgccgcccagggcaatggctacgccccagacggcccacctggggtccgctcccgcagaccctccggcagccagcactcacccagcctgcagaccttcgccccggaggctgacggcaccatcttcttcccagagaggaggccgtcacccttcctgaagagggccgagctcccagggagcagctccccgctgctggcccagccccgaaagccctccggggactcgcagccctcctccccgcgctatggctatgaacccccgctctacgaggagcccccagtggagtaccaggcccccatctacgatgagccccccatggacgtgcaattcgaggctggcgggggctaccaggccggctctccccagcggtcgccgggccgtaagccccggccgttcctccagcccaacaagcagggccccccctcgccctgccagcagctggtgctcaccaagcagaagtgtcccgagcgcttcctgagcctggagtacagtcccgccggcaaggagtacgtgcggcagctggtctacgtggagcaggcgggctccagccccaagctgcgcgccggcccgcggcacaagtacgcgcccaaccccggcggtggttcgtactccttgcagcccagcccctgcctgctgagggaccagcgcctgggcgtcaagtccggagactacagcaccatggagggacctgagctgcggcacagccagccgcccacgccgctgccacaggcccaggaggatgccatgtcctggtccagccagcaggacaccctgtcctccacaggctactccccgggcacgcgcaagcggaagagcagaaagccctctttgtgccaagccaccagcgccacccccactgagggccccggggacctgcttgtggagcagcccctggccgaggaacagcccccgtgcgggaccagcctcgcccccgtgaagcgagcggaaggtgaggccgaaggggcgcggggcgcggccgagcccttcctggcgcaggctcggctggcctgggaggcgcagcaggcccacttccacatgaagcagaggagcagctgggactcccagcaggacggctctggctacgagagcgacggcgccctgccactgcccatgcccgggccggtggtgcgggccttcagcgaggacgaggcgctggcccagcaggagaacaggcactggaggaggggcaccttcgagaagctaggcttcccccagatcctgctggagaagagcgtctccgtgcagaccaacctggcctcaccagagccctacctccacccctcacagtctgaggacctcgctgcctgtgcccagttcgagagcagccggcagagccgcagcggcgttcccagctccagctgcgtcttccccactttcacgctgcgcaagccctcctcggagacggacatcgagaactgggcctccaagcacttcaacaagcacacgcagggcctcttccggcggaaggtgtccatcgccaacatgctggcctggagcagcgagtccatcaagaagcccatgatcgtgacaagcgaccggcacgtgaagaaggaggcctgcgagctcttcaagctgatccagatgtacatgggtgaccggcgggccaaggccgacccactgcacgtggccctggaggtggccaccaagggctggagcgtgcagggcctgcgggacgagctctacatccagctgtgccggcagaccaccgagaacttccgcctggagagcctggcccgcggctgggagctcatggccatctgcctggcctttttcccgcccacccccaagttccactcctacctggaaggctacatctaccggcacatggaccccgtcaatgacactaaaggggtggcgataagcacgtatgccaagtactgttaccacaagctacagaaggcagccctgaccggggccaagaaggggctgaagaagcccaacgtggaggagatccggcatgccaagaacgccgtgttcagcccgtccatgttcggcagcgcactgcaggaggtcatgggcatgcagagagagcgctaccccgagcgccagctgccctgggtgcagacacggctctctgaggaggtgctggcgctcaacggtgaccagacagagggcatcttcagggtccctggggacattgacgaggtgaatgccctgaagctgcaggtggaccagtggaaggtgcccacaggcctggaagacccccacgtccctgcgtccctgctgaagctgtggtaccgggagctggaggagcccctgatcccgcacgagttctacgagcagtgcatcgcgcactacgacagccccgaggcggcggtggccgtggtgcacgcgctgccccgcatcaaccgcatggtgctgtgctacctcatccgcttcctgcaggtcttcgtgcagccggccaacgtcgcggtcaccaagatggatgtcagcaacctggccatggtgatggcgcccaactgcttgcgctgccagtccgacgacccgcgcgtcatcttcgagaacacccgcaaggagatgtccttcctgcgggtgctcatccagcacctggacaccagcttcatggagggtgtgctgtagcgggggcgcccggggacaggagggatgtcctgccgcccccagccaggccgaactccgcactcgctctcccggcagaggggccagaatcgcccggcccagccctggagccccctccactcccccaggcccctggccccggcgctccccacgtcttctgcctggtctgagggtgcagccagggcacagcagcggcggggagggcgcctctggccccccacctcacggccagttcccgcgggcaccgcctcgccctccgctggccgcgggtcagctccgagaaagtgccttctgtgtcctggagccgagcgacgctgcctccttggggccgggctgcctccctgtggctcctgcgcgccctggcctgggccttgcccagccgccccggtctctccttccctttctcctgtcctcgtcctggcctgcagctcttcccagccccgagagagcttcccgacctgtccccgcctcctctccctccctcggcccgtggtccccagctggtgactgctcaggagtttgggggctccaggacagtgggcccggggcctggcaggctctcggtgggtggggtgggggcccccaaaccaaagtcctctggggtagggagcagggctgggcaggcattctgggggcagggtgggggaggggcgagagtatttttttcttcgtgtaactgtaaatccagaatctatcctgcatcgcagcccaccgtgtatagagatataaatagagggaaagatataagaactaaatttgctaatgacatagttttaacctaaatgctatttatctctgagccgtccccgtcctccgtgcagagcaagttgaggtcattccttcttttcttctccgatcttttttcttggcttctgaccaaaaaccaagctctaccccatccccatcccagacctgcaggagacgagcgagcgggaaggcgccgggcccgggactgtccgttctcggggccagagctgctgggggaccgagtttgtacattttccattttggaattttgagttccaattgttgtaaaacttaatttctccccagtttttatatatatattttttagagttccgtttttatttattaaaaacaaaagccccagccctgccgaggcctgggcggcgtcctcagtcgggtggtcccggggcctttgcggtcccgcccggctgagacgctcgccccgacgcatggacccgagaggcgacgacacgagtgaataaagtgcacatggaccctg

SEQ ID NO: 175819 - DNA, 4673 bp, Homo sapiens
  Payload ID: 14524
  Gene Symbol: ARHGAP39
  Gene Name: Rho GTPase activating protein 39
  Uniprot ID: Q9C0H5
  ENST ID: ENST00000377307
  CDS Start-End: 86-3430
gcagtgcggcaccttcccgtctgatgctggcgttgtgcgtatggtgccctgacgtctgtccacgtgggcgcggaagcaaacagcgatgtcccagacgcaggactacgagtgcaggagccataatgtcgacctgccggagtcgaggattccagggtcgaacactcggttggagtgggtggagatcatcgaaccgcgcacccgcgagcgcatgtacgccaacctggtcaccggtgagtgcgtgtgggacccgccggccggcgtccgcatcaagcgcaccagcgagaaccagtggtgggagctgttcgaccccaacacgtcccgcttctactactacaatgccagcacgcagcgcacggtgtggcaccggccgcagggctgcgacatcatcccgctggccaagctgcagacgctgaagcagaacacggagtccccgcgcgcctcggcggagagcagccccgggcgcggcagcagcgtcagccgtgagggcagcaccagctcctccctggagcccgagcccgacactgagaaagcgcaggagttgccagcgagggccgggcggcccgcggcgtttgggacagtgaaggaggacagcggcagctcttcaccaccaggagtgttccttgagaaggactatgagatttaccgggattacagtgcggacggccagcttcttcactacaggacctcctcgctgcggtggaactcgggcgccaaagagcgcatgctcatcaaggtcgctgatcgggagcccagcttcctcgccgcccagggcaatggctacgccccagacggcccacctggggtccgctcccgcagaccctccggcagccagcactcacccagcctgcagaccttcgccccggaggctgacggcaccatcttcttcccagagaggaggccgtcacccttcctgaagagggccgagctcccagggagcagctccccgctgctggcccagccccgaaagccctccggggactcgcagccctcctccccgcgctatggctatgaacccccgctctacgaggagcccccagtggagtaccaggcccccatctacgatgagccccccatggacgtgcaattcgaggctggcgggggctaccaggccggctctccccagcggtcgccgggccgtaagccccggccgttcctccagcccaacaagcagggccccccctcgccctgccagcagctggtgctcaccaagcagaagtgtcccgagcgcttcctgagcctggagtacagtcccgccggcaaggagtacgtgcggcagctggtctacgtggagcaggcgggctccagccccaagctgcgcgccggcccgcggcacaagtacgcgcccaaccccggcggtggttcgtactccttgcagcccagcccctgcctgctgagggaccagcgcctgggcgtcaagtccggagactacagcaccatggagggacctgagctgcggcacagccagccgcccacgccgctgccacaggcccaggaggatgccatgtcctggtccagccagcaggacaccctgtcctccacaggctactccccgggcacgcgcaagcggaagagcagaaagccctctttgtgccaagccaccagcgccacccccactgagggccccggggacctgcttgtggagcagcccctggccgaggaacagcccccgtgcgggaccagcctcgcccccgtgaagcgagcggaaggtgaggccgaaggggcgcggggcgcggccgagcccttcctggcgcaggctcggctggcctgggaggcgcagcaggcccacttccacatgaagcagaggagcagctgggactcccagcaggacggctctggctacgagagcgacggcgccctgccactgcccatgcccgggccggtggtgcgggccttcagcgaggacgaggcgctggcccagcaggagaacaggcactggaggaggggcaccttcgagaagctaggcttcccccagatcctgctggagaagagcgtctccgtgcagaccaacctggcctcaccagagccctacctccacccctcacagtctgaggacctcgctgcctgtgcccagttcgagagcagccggcagagccgcagcggcgttcccagctccagctgcgtcttccccactttcacgctgcgcaagccctcctcggagacggacatcgagaactgggcctccaagcacttcaacaagcacacgcagggcctcttccggcggaaggtgtccatcgccaacatgctggcctggagcagcgagtccatcaagaagcccatgatcgtgacaagcgaccggcacgtgaagaaggaggcctgcgagctcttcaagctgatccagatgtacatgggtgaccggcgggccaaggccgacccactgcacgtggccctggaggtggccaccaagggctggagcgtgcagggcctgcgggacgagctctacatccagctgtgccggcagaccaccgagaacttccgcctggagagcctggcccgcggctgggagctcatggccatctgcctggcctttttcccgcccacccccaagttccactcctacctggaaggctacatctaccggcacatggaccccgtcaatgacactaaagtgacacagcacataaaagagctcctggaaagaaacactaagaagaagtccaaattgagaaagaaacccaagccttatgttgaagagccggatggggtggcgataagcacgtatgccaagtactgttaccacaagctacagaaggcagccctgaccggggccaagaaggggctgaagaagcccaacgtggaggagatccggcatgccaagaacgccgtgttcagcccgtccatgttcggcagcgcactgcaggaggtcatgggcatgcagagagagcgctaccccgagcgccagctgccctgggtgcagacacggctctctgaggaggtgctggcgctcaacggtgaccagacagagggcatcttcagggtccctggggacattgacgaggtgaatgccctgaagctgcaggtggaccagtggaaggtgcccacaggcctggaagacccccacgtccctgcgtccctgctgaagctgtggtaccgggagctggaggagcccctgatcccgcacgagttctacgagcagtgcatcgcgcactacgacagccccgaggcggcggtggccgtggtgcacgcgctgccccgcatcaaccgcatggtgctgtgctacctcatccgcttcctgcaggtcttcgtgcagccggccaacgtcgcggtcaccaagatggatgtcagcaacctggccatggtgatggcgcccaactgcttgcgctgccagtccgacgacccgcgcgtcatcttcgagaacacccgcaaggagatgtccttcctgcgggtgctcatccagcacctggacaccagcttcatggagggtgtgctgtagcgggggcgcccggggacaggagggatgtcctgccgcccccagccaggccgaactccgcactcgctctcccggcagaggggccagaatcgcccggcccagccctggagccccctccactcccccaggcccctggccccggcgctccccacgtcttctgcctggtctgagggtgcagccagggcacagcagcggcggggagggcgcctctggccccccacctcacggccagttcccgcgggcaccgcctcgccctccgctggccgcgggtcagctccgagaaagtgccttctgtgtcctggagccgagcgacgctgcctccttggggccgggctgcctccctgtggctcctgcgcgccctggcctgggccttgcccagccgccccggtctctccttccctttctcctgtcctcgtcctggcctgcagctcttcccagccccgagagagcttcccgacctgtccccgcctcctctccctccctcggcccgtggtccccagctggtgactgctcaggagtttgggggctccaggacagtgggcccggggcctggcaggctctcggtgggtggggtgggggcccccaaaccaaagtcctctggggtagggagcagggctgggcaggcattctgggggcagggtgggggaggggcgagagtatttttttcttcgtgtaactgtaaatccagaatctatcctgcatcgcagcccaccgtgtatagagatataaatagagggaaagatataagaactaaatttgctaatgacatagttttaacctaaatgctatttatctctgagccgtccccgtcctccgtgcagagcaagttgaggtcattccttcttttcttctccgatcttttttcttggcttctgaccaaaaaccaagctctaccccatccccatcccagacctgcaggagacgagcgagcgggaaggcgccgggcccgggactgtccgttctcggggccagagctgctgggggaccgagtttgtacattttccattttggaattttgagttccaattgttgtaaaacttaatttctccccagtttttatatatatattttttagagttccgtttttatttattaaaaacaaaagccccagccctgccgaggcctgggcggcgtcctcagtcgggtggtcccggggcctttgcggtcccgcccggctgagacgctcgccccgacgcatggacccgagaggcgacgacacgagtgaataaagtgcacatggaccctg

SEQ ID NO: 175820 - DNA, 3235 bp, Homo sapiens
  Payload ID: 14525
  Gene Symbol: ARHGAP4
  Gene Name: Rho GTPase activating protein 4
  Uniprot ID: P98171
  ENST ID: ENST00000350060
  CDS Start-End: 43-2883
cgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccg

SEQ ID NO: 175821 - DNA, 3095 bp, Homo sapiens
  Payload ID: 14525
  Gene Symbol: ARHGAP4
  Gene Name: Rho GTPase activating protein 4
  ENST ID: ENST00000370016
  CDS Start-End: 43-2820
cgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaaggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctg

SEQ ID NO: 175822 - DNA, 3372 bp, Homo sapiens
  Payload ID: 14525
  Gene Symbol: ARHGAP4
  Gene Name: Rho GTPase activating protein 4
  Uniprot ID: P98171
  ENST ID: ENST00000370028
  CDS Start-End: 59-3019
ggcccgctcacggccgcgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagctctggcccccgcagaggcctgtggccgcttccagctgtgcacctgtgtgctggctccaagctgggtttctcgtgcaccctccatggtggggtgccatgtgcgcaccttccactcatcagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccga

SEQ ID NO: 175823 - DNA, 2721 bp, Homo sapiens
  Payload ID: 14525
  Gene Symbol: ARHGAP4
  Gene Name: Rho GTPase activating protein 4
  ENST ID: ENST00000393721
  CDS Start-End: 53-2359
ctcacggccgcgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagcca

SEQ ID NO: 175824 - DNA, 3232 bp, Homo sapiens
  Payload ID: 14525
  Gene Symbol: ARHGAP4
  Gene Name: Rho GTPase activating protein 4
  ENST ID: ENST00000404127
  CDS Start-End: 104-757
gcccgcgcagggtgctggccgcagcgcccccaagtcccggcgccgggcccgctcacggccgcgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacgcaccaccttgctttgggtctccctgcaggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggcctgcagcatgaaggcatcttccgggtatcgggtgcccagctccgggtctcagagatccgtgatgccttcgagagaggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaag

SEQ ID NO: 175825 - DNA, 2817 bp, Homo sapiens
  Payload ID: 14525
  Gene Symbol: ARHGAP4
  Gene Name: Rho GTPase activating protein 4
  ENST ID: ENST00000420383
  CDS Start-End: 43-1920
cgtgggagcagtggggttcgacggcgcggccgcgaggccgccatggccgctcacgggaagctgcggcgggagcgggggctgcaggctgagtatgagacgcaagtcaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcccttcagcgaggtgacaaggaggagcaggaggtgtcttggacccagtacacacagagaaaattccagaagagccgccagccccgccccagctcccagtataaccagagactctttgggggagacatggagaagtttatccagagctcaggccagcctgtgcccctggtggtggagagctgcattcgcttcatcaacctcaatggggaggacccactggtggagggctgcactgcccatgacctggactcggtggccggggtgctgaagctctacttccggagcctggagcccccactcttccccccagacctgttcggcgagctgctggcttcttcggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcctcctggcatcggagctggtccaccggccagagccatgcacctcacctgaggccatgggaccctctggacacagacgacgctgcttggtcccagcctccccagagcaacacgtggaggtggataaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccg

SEQ ID NO: 175826 - DNA, 642 bp, Homo sapiens
  Payload ID: 14525
  Gene Symbol: ARHGAP4
  Gene Name: Rho GTPase activating protein 4
  ENST ID: ENST00000422918
  CDS Start-End: 1-642
gagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtggctgagatctgcgttgaaatggagctgcgggacgagattctgcccagagcccagaacatccagagccgcctggaccgacagaccattgagacagaggagaccagcccctccaccgagtccctcaagtccaccagctcagacccaggcagccggcaggcgggccggaggcgcggccagcagcaggagaccgaaaccttctacctcacgaagctccaggagtatctgagtggacggagcatcctcgccaagctgcaggccaagcacgagaagctgcaggaggcc

SEQ ID NO: 175827 - DNA, 625 bp, Homo sapiens
  Payload ID: 14525
  Gene Symbol: ARHGAP4
  Gene Name: Rho GTPase activating protein 4
  ENST ID: ENST00000442262
  CDS Start-End: 96-625
gacgtgggcttccctttgtatgggccggaggcggagtcctgtcccgccccgcgcctggcggcagtgtcttccggttcgcaagcccgcggcgagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgt

SEQ ID NO: 175828 - DNA, 880 bp, Homo sapiens
  Payload ID: 14525
  Gene Symbol: ARHGAP4
  Gene Name: Rho GTPase activating protein 4
  ENST ID: ENST00000442172
  CDS Start-End: 1-880
gaaaattccagaagagccgccagccccgccccagctcccagtataaccagagactctttgggggagacatggagaagtttatccagagctcaggccagcctgtgcccctggtggtggagagctgcattcgcttcatcaacctcaatggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccacctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctgggggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgg

SEQ ID NO: 175829 - DNA, 586 bp, Homo sapiens
  Payload ID: 14525
  Gene Symbol: ARHGAP4
  Gene Name: Rho GTPase activating protein 4
  ENST ID: ENST00000418750
  CDS Start-End: 1-586
gagtcacattgcagaggacgtggggcgcctggtcaagaaggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagctctggcccccgcagaggcctgtggccgcttccagctgtgcacctgtgtgctggctccaagctgggtttctcgtgcaccctccatggtggggtgccatgtgcgcaccttccactcatcagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagct

SEQ ID NO: 175830 - DNA, 747 bp, Homo sapiens
  Payload ID: 14525
  Gene Symbol: ARHGAP4
  Gene Name: Rho GTPase activating protein 4
  ENST ID: ENST00000454164
  CDS Start-End: 1-747
tcctggcacccagcacccagttcccagcacctggcatgggaggccatcctggaggggctggggaagatgctcagtgcccaccagctccttgtcctcccacaggcctgcagcatgaaggcatcttccgggtatcgggtgcccagctccgggtctcagagatccgtgatgccttcgagagaggggaggacccactggtggagggctgcactgcccatgacctggactcggtggccggggtgctgaagctctacttccggagcctggagcccccactcttccccccagacctgttcggcgagctgctggcttcttcggagctggaggccacagcggagagggtggagcacgtgagccgcctgctgtggcggctgcccgcgccggtgctggtggttctgcgctacctcttcaccttcctcaaccaggacgcccagctggagagcctgggggcggacaatgagccggagctggaagccgagatgcccgcacaggaggatgacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggacggagaagcaggtggtgggcgcagggctgcagactgcaggggagtctgggagcagtcccgagggcc

SEQ ID NO: 175831 - DNA, 570 bp, Homo sapiens
  Payload ID: 14525
  Gene Symbol: ARHGAP4
  Gene Name: Rho GTPase activating protein 4
  ENST ID: ENST00000422091
  CDS Start-End: 48-570
tcccctaccaagggggcctggagggaacggcagccagctgctgagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggcc

SEQ ID NO: 175832 - DNA, 1123 bp, Homo sapiens
  Payload ID: 14525
  Gene Symbol: ARHGAP4
  Gene Name: Rho GTPase activating protein 4
  ENST ID: ENST00000461052
  CDS Start-End: 171-1123
tctcaaggctccctggggctccctgggcctctctgggggctgacttgggaagggaggaccccatcggatgtctgggggaaggaggcaacccagggggagtccagagcctggggcagcaatggtgttcatggccactggtacagtgggccagcggccccgctgtgaatgagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatga

SEQ ID NO: 175833 - DNA, 960 bp, Homo sapiens
  Payload ID: 14525
  Gene Symbol: ARHGAP4
  Gene Name: Rho GTPase activating protein 4
  ENST ID: ENST00000488269
  CDS Start-End: 128-960
tccgtgtgtttgcaagggaggctgccacctcccggagcctgggtaccggcgggaaaggaagtcgcaggggaaaccattcagaggctttccaggaacgagggagagacaggaagccaaactgaaagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaagagcagggatctggagcagcagctgcaggatgagctcctggaggtggtctcagagctccagacggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaagcggcaggccaagttcatggagcacaaactcaagtgcacaaaggcgcgcaacgagtacctgcttagcctggctagtgtcaacgctgctgtcagtaactactacctgcatgacgtcttggacctcatggactgctgtgacacagggttccacctggccctggggcaggtgctccggagctacacggccgctgagagccgcacccaagcctcccaagtgcaggg

SEQ ID NO: 175834 - DNA, 1825 bp, Homo sapiens
  Payload ID: 14526
  Gene Symbol: ARHGAP40
  Gene Name: Rho GTPase activating protein 40
  ENST ID: ENST00000243967
  CDS Start-End: 1-1777
aggggaagctgaatcccagtggctgcaggacacaggcctgtcgggcctccttggtggcctgggcttggatggtgatcaccaggagctcctgtccaccctgacacagacccaggtggccgctgtgtgccgccggctggacatctatgctcgctcagtgcgaagacaacacaagacacctgtcagagatgtcagggatgtctttggggtcttcaattcagggaaaatgtcgtcagagaatggcgactccggtatgaagggggcccagctcagttccggggcctctaagtttcctccagcagcagagcctggggggctgcaggagcaggctgggagggaagaagccttcaacatggactctgcctactcagaacaagctgcggtgctcctgcagaggagcaggccatcccggggaggcacctctgcctggggcaagtgttccctgccgaagtttaccgtccccaaaggcagacttggcgtgacgaggataggagacttgtccctgcaggatatgaggaaggtaccttctctggccctcatagagctgaccgcgctctgtgacatcctcggcttggacctgaagaggagcaaggcggggaagtggaaagcggcagaaactcgcctctttggtgtgccccttgacagcctgctagaagctgaccacaaagtcctccccagcacacaggtcccgctggtccttcaagccctgctgtcctgtttggaaaagagaggactggacatggaaggcattctcagggtgcccggatcccaggccagggtcaaggggctggaacagaaactggagagagacttctatgctggcctttttagctgggacgaggttcatcacaatgacgcctctgatttgctcaaaaggttcatccggaagctgccgacacctttgctcacggctgagtacctcccggccttcgccgtggtgcctaacatccccaacctgaagcagcgcctgcaggttcttcacctgctcatcctcatcctcccagaacccaacagaaatgccttaaaggcactgctggaattcctcaggaaggtggtggcccgggaacagcacaacaagatgactctgaggaatgtttccaccgtgatggcccctaacctctttctgcaccaagggcggccccccaagctccccaaaggcaaggagaagcagctggcagaaggggcagccgaggtggtgcagataatggtgcactaccaggatctgctgtggacggtcgcctctttcctggtcgcccaggtgcgaaaactgaacgacagtagcagcaggcgcccccagctctgcgacgcaggcctcaagacttggctgcggaggatgcacgcagacagggacaaggcgggggacggcctcgaggcgactcccaaggtggcaaagatccaggtggtctggcctatcaaggaccccttgaaggtgcctctcacccccagcaccaaagtggcccacgtcctgaggcagttcacagagcacctcagccctggttccaagggtcaagaagacagtgaggacatggacagcctccttctacaccataggtccatggagtcagccaacatcctcctctatgaagttggagggaatatcaatgagcatcgcctggacccagatgcctacctcttagatctgtaccgtgccaacccgcatggcaaaattgtttcgaaagtggccctacaatgtgtagtagcagcagcaccagagacaaaaccaggagagctctgtgaccttggacaagccccttgccctctcagaatcctttcaggatgaggggctagggcctcagggagaggaagccaagattgtagccatgaccag

SEQ ID NO: 175835 - DNA, 2841 bp, Homo sapiens
  Payload ID: 14526
  Gene Symbol: ARHGAP40
  Gene Name: Rho GTPase activating protein 40
  Uniprot ID: Q5TG30
  ENST ID: ENST00000373345
  CDS Start-End: 169-2037
tgccagcccatggccgagcctgccctcctccccgccgcccagatggagaggctggccccagggcccctagcctcaccgtgtcctcggatcccgcgggcccgcattgccaggcgctgcgcccagcgctgggccgacctgggctgcagctctggcccctcctcaggccgaatggatcagcttccccagaagaatctcctgcgactacaccctgctggctctgctggctgttccactggagtggagagctccagcatggatggcttttggatggaggtggaacagatccaacagagagatgagctgagggaagaggacagtggcgggaatgaaggccagcttccagaggaaggggaagctgaatcccagtggctgcaggacacaggcctgtcgggcctccttggtggcctgggcttggatggtgatcaccaggagctcctgtccaccctgacacagacccaggtggccgctgtgtgccgccggctggacatctatgctcgctcagtgcgaagacaacacaagacacctgtcagagatgtcagggatgtctttggggtcttcaattcagggaaaatgtcgtcagagaatggcgactccggtatgaagggggcccagctcagttccggggcctctaagtttcctccagcagcagagcctggggggctgcaggagcaggctgggagggaagaagccttcaacatggactctgcctactcagaacaagctgcggtgctcctgcagaggagcaggccatcccggggaggcacctctgcctggggcaagtgttccctgccgaagtttaccgtccccaaaggcagacttggcgtgacgaggataggagacttgtccctgcaggatatgaggaaggtaccttctctggccctcatagagctgaccgcgctctgtgacatcctcggcttggacctgaagaggagcaaggcggggaagtggaaagcggcagaaactcgcctctttggtgtgccccttgacagcctgctagaagctgaccacaaagtcctccccagcacacaggtcccgctggtccttcaagccctgctgtcctgtttggaaaagagaggactggacatggaaggcattctcagggtgcccggatcccaggccagggtcaaggggctggaacagaaactggagagagacttctatgctggcctttttagctgggacgaggttcatcacaatgacgcctctgatttgctcaaaaggttcatccggaagctgccgacacctttgctcacggctgagtacctcccggccttcgccgtggtgcctaacatccccaacctgaagcagcgcctgcaggttcttcacctgctcatcctcatcctcccagaacccaacagaaatgccttaaaggcactgctggaattcctcaggaaggtggtggcccgggaacagcacaacaagatgactctgaggaatgtttccaccgtgatggcccctaacctctttctgcaccaagggcggccccccaagctccccaaaggcaaggagaagcagctggcagaaggggcagccgaggtggtgcagataatggtgcactaccaggatctgctgtggacggtcgcctctttcctggtcgcccaggtgcgaaaactgaacgacagtagcagcaggcgcccccagctctgcgacgcaggcctcaagacttggctgcggaggatgcacgcagacagggacaaggcgggggacggcctcgaggcgactcccaaggtggcaaagatccaggtggtctggcctatcaaggaccccttgaaggtgcctctcacccccagcaccaaagtggcccacgtcctgaggcagttcacagagcacctcagccctggttccaagggtcaagaagacagtgaggacatggacagcctccttctacaccataggtccatggagtcagccaacatcctcctctatgaagttggagggaatatcaatgagcatcgcctggacccagatgcctacctcttagatctgtaccgtgccaacccgcatggtgagtgggtccttaaacagaaccccacctaaaccctgcgagtctcaggagcagcctggatgcctcctcctctcccctgctggctctgtgtccatgtacccagcatgagaacaaagctattccaggggagggtctgagttttattccaaggcttccttttctgaaatgcctctcagacccctcagaaatagactcaggggtggtgctctctccactcagaggggatgaggggctagggcctcagggaggggaggccaacactgtagccatgatcagccctggaagaactggacagaggaagaacttcccttcacagctctcatgttttaaccgtgcacacaatgccctcactcccctccaccctccagccctccagagagttgcttcctacaccaagcttgctgtatgacgccaccacttggggcgcttggatctccatgggcttctgtctgtggcttccagactggaggaaaattaaaaatgcagtacctttatcaagaggtagttggggtcttttccccccaggcaaaattgtttcgaaagtggccctacaatgtgtagtagcagcagcaccagagacaaaaccaggagagctctgtgaccttggacaagccccttgccctctcagaatcctttcaggatgaggggctagggcctcagggagaggaagccaagattgtagccatgaccagccccgggagaaatggacagaggaagactttgcttcacagctctcatgctttacatgttgatttgtacaatcttgtcattttgtaatatgatataatatgtaaacgtaattgtttaaacagtaaaggcacaacaagttcaatgtc

SEQ ID NO: 175836 - DNA, 994 bp, Homo sapiens
  Payload ID: 14526
  Gene Symbol: ARHGAP40
  Gene Name: Rho GTPase activating protein 40
  ENST ID: ENST00000373346
  CDS Start-End: 1-463
gacggtcgcctctttcctggtcgcccaggtgcgaaaactgaacgacagtagcagcaggcgcccccagctctgcgacgcaggcctcaagacttggctgcggaggatgcacgcagacagggacaaggcgggggacggcctcgaggcgactcccaaggtggcaaagatccaggtggtctggcctatcaaggaccccttgaaggtgcctctcacccccagcaccaaagtggcccacgtcctgaggcagttcacagagcacctcagccctggttccaagggtcaagaagacagtgaggacatggacagcctccttctacaccataggtccatggagtcagccaacatcctcctctatgaagttggagggaatatcaatgagcatcgcctggacccagatgcctacctcttagatctgtaccgtgccaacccgcatggtgagtgggtccttaaacagaaccccacctaaaccctgcgagtctcaggagcagcctggatgcctcctcctctcccctgctggctctgtgtccatgtacccagcatgagaacaaagctattccaggggagggtctgagttttattccaaggcttccttttctgaaatgcctctcagacccctcagaaatagactcaggggtggtgctctctccactcagaggggatgaggggctagggcctcagggaggggaggccaacactgtagccatgatcagccctggaagaactggacagaggaagaacttcccttcacagctctcatgttttaaccgtgcacacaatgccctcactcccctccaccctccagccctccagagagttgcttcctacaccaagcttgctgtatgacgccaccacttggggcgcttggatctccatgggcttctgtctgtggcttccagactggaggaaaattaaaaatgcagtacctttatcaagaggtagttggggtcttttccccccaggcaaaattgtttcgaaagtggccctacaatgtgtagta

SEQ ID NO: 175837 - DNA, 534 bp, Homo sapiens
  Payload ID: 14526
  Gene Symbol: ARHGAP40
  Gene Name: Rho GTPase activating protein 40
  ENST ID: ENST00000414158
  CDS Start-End: 1-218
agcacctcagccctggttccaagggtcaagaagacagtgaggacatggacagcctccttctacaccataggtccatggagtcagccaacatcctcctctatgaagttggagggaatatcaatgagcatcgcctggacccagatgcctacctcttagatctgtaccgtgccaacccgcatgtccagtgctcggtaggtgttgtccttccagcgagttgacgtgggagcttggtgacgagagcatcttgctgagctgctcaaagggctctggcccatgtgatccagccacgccttgaacccacaaccaccgggggcgggagggcaggaagagaactcagaatggggaggcatggagtaatgatacccattgctgaagggtgggggcattgcagggacagcctctctgggaatcctctcatctcctacagtcccaggtctcacccttcctcttctcctctgccctgggtctgtatcctcaggccaggtgaggcttcgcttatttgttcacttaacaatgagtttactgagcatttaa

SEQ ID NO: 175838 - DNA, 4752 bp, Homo sapiens
  Payload ID: 14527
  Gene Symbol: ARHGAP42
  Gene Name: Rho GTPase activating protein 42
  Uniprot ID: A6NI28
  ENST ID: ENST00000298815
  CDS Start-End: 4-2628
gccatggggctgcccactctggagttcagcgattcctacttggacagcccagatttcagggagcgcttgcagtgtcacgagattgagctggagcgaaccaacaagttcatcaaggagctcattaaggacggctctctgctcattggggcgttgaggaatctgtctatggcagtgcagaaattttcccagtcattgcaagatttccagtttgaatgtattggtgatgctgaaacagatgatgaaattagtattgctcagtcactaaaagaatttgcaagactactcattgcagtagaagaagaaaggcgaagactgatccaaaacgctaacgatgtattaattgcaccacttgagaaatttcgaaaagaacagataggtgcagcaaaagatggaaagaagaagtttgacaaagagagtgaaaaatattactctatccttgaaaagcatttaaatttgtccgcaaagaaaaaggagtctcatttacaagaggcagatacacaaattgaccgagaacatcagaacttctatgaagcatcattagaatatgtctttaaaattcaagaggtccaagaaaaaaagaagtttgaatttgttgaaccgcttttgtcatttcttcagggcttatttactttttaccatgagggatatgaacttgcccaggaatttgcaccgtataagcaacagctgcagttcaacttgcagaatacaaggaataattttgaaagtactcgacaagaggtagagcggttgatgcaaaggatgaaatctgctaaccaggactacagaccacccagccagtggacgatggaaggctatctgtatgtccaggagaaacgaccgcttggttttacatggattaaacattattgtacatatgataagggaagtaaaacatttacaatgagtgtttcagaaatgaaatccagtgggaaaatgaatggccttgttactagctcaccggaaatgtttaaattaaaatcttgtatccgacgaaagacagattcaattgacaaacgattctgctttgacatagaagtagttgaaaggcatgggatcatcacgttacaggccttctcagaagctaataggaaactctggcttgaagccatggatgggaaggaaccgatttatactctgcctgccattataagcaagaaagaagaaatgtatttgaatgaagcagggttcaactttgtgagaaaatgcattcaagctgtggaaacaagaggtatcaccattttaggactctaccgaataggaggagtgaactccaaagttcaaaaactcatgaataccacattttctcctaaatcccctcctgatattgatattgatattgaactgtgggacaataagacgataacaagtgggctgaaaaactacctcaggtgccttgcagaaccactgatgacttacaagttgcacaaagattttatcattgctgttaaatctgatgatcaaaactacagggtggaggctgtacatgcattggtgcacaaattgccggagaaaaacagagagatgctggacatcttaataaagcatctggtcaaagtatcactacacagccaacaaaatctcatgactgtctcaaatcttggtgtcatatttggcccaactctaatgagagcacaggaagaaactgtggctgctatgatgaatattaaatttcagaatattgtggtagaaattctgatagagcactatgaaaagatttttcatactgctccagacccaagcattcctcttcctcagcctcagtctcgatctggatcccgaaggacacgagcaatctgcctctctacagggtctaggaagcccagagggaggtatactccatgcctggccgaacctgatagtgactcctatagcagcagcccagacagcacacctatggggagcattgagtcactctcttctcattcctctgaacaaaatagcactacaaagtcagcttcctgccagcccagggagaaatctggagggattccttggattgcaaccccatcatcttccaatggacagaaaagccttggtctgtggacaactagtcctgaatcaagttccagagaagatgcaaccaagacagatgcagaatcagactgccagagtgttgcttcagtcactagcccaggagacgtttccccacccatagacctagtcaagaaagagccttatgggctttcaggactgaaaagagcttctgcttcttctctcagatccatctctgcagctgaaggaaacaagagctacagtggatctattcaaagcttaacttctgtaggttccaaggagacacccaaagcttcaccaaacccagacctgcctccgaaaatgtgcaggagattaagactagacactgcctcaagcaatggctatcagcggcctggctcagtagtggcagcaaaagctcaactgtttgaaaatgttggttcacctaaaccagtttcttctgggcgccaagccaaagccatgtactcctgtaaagcagagcacagtcatgagctttccttcccacaaggagcaatattttctaatgtgtacccatcagtggaaccaggatggttaaaggcaacttatgaaggcaaaacaggactagttccagaaaattatgttgtcttcctctaatactatttagtggatggcagtatcttcatggtatccatggtaacgaataaatgctatgattttatctgacacagatacacggggatcagcccactaagtgaaaacagtcaatttctatcaagttcttcaccagcagactatgtagctccttattaatggaaaaaaagatttaaattgttggccattcttttttggttggtttcttattttaaaatatcttacttgtgaaaaatgtgtttttggataatatgtaactctccacaatgtcgcttccgtagcaattgtagagtttcaaatactgtgttaaatactgtatcccagaaatttggaaaccagaaatctgctatatggattttgagatctgtcctttactgcctggcattctctgaggatctctgaaattgttacttaaaaatgtaatttaaattgttcatttattgttttttttttcttagaaatatactgcttttatatatgattgttttgctggtcctaaacatttcaaggatgtaagtctttgttttaatataactttatttgttttccaagtagatgataatattcaaaagcaataatgtatatgatatctataaaggaagcaaaattaagtcatacactgattccactgtaaacaatctgtccagaattccagacaccttcagcaaactttttctgtaaaggcctgatagcaaatatttttgtggtgggttgaatttggcttatgggttatagtttgctgacacctagtttagagggtgtgtaaaactatcttcataactttgagatttttataaaattttacatgaaaatatactgataaattatatgcacatattttctaccagtagcattatagtggcatcatagaagaatatttaccaatgatggggaaactgtaaaactacagtatcaaggcatacaacttaaattccacttggaagattgtaaagtgtcaaagtattttaatgataatttaatttgggcttttgaaatgttcttctacaaatgaaaaagatgtttaaaaacgttacaagggaagctatgccttctgaagtctatccttagttgaaacagaaaataaacacaaaggtacaagatccttaaattattttgaaccacagaggttgaaattgttttgtgatcttcagcagaaataaaatctgtacatgattttcttttatgccttttagtttacagtctttattagcaatttcagtgaatttgtagagcatagtaataggtatttactgtccacttatatatatcagcatctggtcatgcacgaaccattaattctatatttctatttcaataattctaatatattatttctataaatgtaatatctgtatgtggcaaagagcctttcttctcaagatcctgaaaagctggttacctgccctttgagtgccacagtcctgaactgcttgttcttgacatcttgcatattacttcagagttccccactgtgcagactctcaggtattaactgtaaaaaactctttacatgccattattatctgtaatctctatctcttctactttaaattaatgtttctagaattaataggttaaatacacatacacacacacaactatgcctcagaaaagttaggcttttacaaataaaaagaataagattagaattaacaagtagagagaataacggtaggcagagtcagaatcaggaataaatatcagtgaatcaaaagaatgaaaaatattatgtaataaaaattagcaatgtaatgtaaacgtttgataaaagagtatctttttcttttatctcttactgttgacctctgtgcactgtaataaggtgtgttgctggatcttcttggtcgaggtccttggtgaccttagtagtaataacagcattgctgacaccctaattgccctctgctggaacagaaggtagttttccagtgtaccagtcccttagtctatacagcacccttggtttaagcacacttgccatcatctggtatcctgctagactagaatctcttaaaagcaaattggttttctttcaaagaccaacttgactccaaagagagattcagaatcctacttctcctgctgctgcataaagaatctcaaccttcattttatttgaacacggac

SEQ ID NO: 175839 - DNA, 5685 bp, Homo sapiens
  Payload ID: 14527
  Gene Symbol: ARHGAP42
  Gene Name: Rho GTPase activating protein 42
  ENST ID: ENST00000524892
  CDS Start-End: 27-2549
cggccgccgctggcagcgcctgtgccatggggctgcccactctggagttcagcgattcctacttggacagcccagatttcagggagcgcttgcagtgtcacgagattgagctggagcgaaccaacaagttcatcaaggagctcattaaggacggctctctgctcattggggcgttgaggaatctgtctatggcagtgcagaaattttcccagtcattgcaagatttccagtttgaatgtattggtgatgctgaaacagatgatgaaattagtattgctcagtcactaaaagaatttgcaagactactcattgcagtagaagaagaaaggcgaagactgatccaaaacgctaacgatgtattaattgcaccacttgagaaatttcgaaaagaacagataggtgcagcaaaagcagatacacaaattgaccgagaacatcagaacttctatgaagcatcattagaatatgtctttaaaattcaagaggtccaagaaaaaaagaagtttgaatttgttgaaccgcttttgtcatttcttcagggcttatttactttttaccatgagggatatgaacttgcccaggaatttgcaccgtataagcaacagctgcagttcaacttgcagaatacaaggaataattttgaaagtactcgacaagaggtagagcggttgatgcaaaggatgaaatctgctaaccaggactacagaccacccagccagtggacgatggaaggctatctgtatgtccaggagaaacgaccgcttggttttacatggattaaacattattgtacatatgataagggaagtaaaacatttacaatgagtgtttcagaaatgaaatccagtgggaaaatgaatggccttgttactagctcaccggaaatgtttaaattaaaatcttgtatccgacgaaagacagattcaattgacaaacgattctgctttgacatagaagtagttgaaaggcatgggatcatcacgttacaggccttctcagaagctaataggaaactctggcttgaagccatggatgggaaggaaccgatttatactctgcctgccattataagcaagaaagaagaaatgtatttgaatgaagcagggttcaactttgtgagaaaatgcattcaagctgtggaaacaagaggtatcaccattttaggactctaccgaataggaggagtgaactccaaagttcaaaaactcatgaataccacattttctcctaaatcccctcctgatattgatattgatattgaactgtgggacaataagacgataacaagtgggctgaaaaactacctcaggtgccttgcagaaccactgatgacttacaagttgcacaaagattttatcattgctgttaaatctgatgatcaaaactacagggtggaggctgtacatgcattggtgcacaaattgccggagaaaaacagagagatgctggacatcttaataaagcatctggtcaaagtatcactacacagccaacaaaatctcatgactgtctcaaatcttggtgtcatatttggcccaactctaatgagagcacaggaagaaactgtggctgctatgatgaatattaaatttcagaatattgtggtagaaattctgatagagcactatgaaaagatttttcatactgctccagacccaagcattcctcttcctcagcctcagtctcgatctggatcccgaaggacacgagcaatctgcctctctacagggtctaggaagcccagagggaggtatactccatgcctggccgaacctgatagtgactcctatagcagcagcccagacagcacacctatggggagcattgagtcactctcttctcattcctctgaacaaaatagcactacaaagtcagcttcctgccagcccagggagaaatctggagggattccttggattgcaaccccatcatcttccaatggacagaaaagccttggtctgtggacaactagtcctgaatcaagttccagagaagatgcaaccaagacagatgcagaatcagactgccagagtgttgcttcagtcactagcccaggagacgtttccccacccatagacctagtcaagaaagagccttatgggctttcaggactgaaaagagcttctgcttcttctctcagatccatctctgcagctgaaggaaacaagagctacagtggatctattcaaagcttaacttctgtaggttccaaggagacacccaaagcttcaccaaacccagacctgcctccgaaaatgtgcaggagattaagactagacactgcctcaagcaatggctatcagcggcctggctcagtagtggcagcaaaagctcaactgtttgaaaatgttggttcacctaaaccagtttcttctgggcgccaagccaaagccatgtactcctgtaaagcagagcacagtcatgagctttccttcccacaaggagcaatattttctaatgtgtacccatcagtggaaccaggatggttaaaggcaacttatgaaggcaaaacaggactagttccagaaaattatgttgtcttcctctaatactatttagtggatggcagtatcttcatggtatccatggtaacgaataaatgctatgattttatctgacacagatacacggggatcagcccactaagtgaaaacagtcaatttctatcaagttcttcaccagcagactatgtagctccttattaatggaaaaaaagatttaaattgttggccattcttttttggttggtttcttattttaaaatatcttacttgtgaaaaatgtgtttttggataatatgtaactctccacaatgtcgcttccgtagcaattgtagagtttcaaatactgtgttaaatactgtatcccagaaatttggaaaccagaaatctgctatatggattttgagatctgtcctttactgcctggcattctctgaggatctctgaaattgttacttaaaaatgtaatttaaattgttcatttattgttttttttttcttagaaatatactgcttttatatatgattgttttgctggtcctaaacatttcaaggatgtaagtctttgttttaatataactttatttgttttccaagtagatgataatattcaaaagcaataatgtatatgatatctataaaggaagcaaaattaagtcatacactgattccactgtaaacaatctgtccagaattccagacaccttcagcaaactttttctgtaaaggcctgatagcaaatatttttgtggtgggttgaatttggcttatgggttatagtttgctgacacctagtttagagggtgtgtaaaactatcttcataactttgagatttttataaaattttacatgaaaatatactgataaattatatgcacatattttctaccagtagcattatagtggcatcatagaagaatatttaccaatgatggggaaactgtaaaactacagtatcaaggcatacaacttaaattccacttggaagattgtaaagtgtcaaagtattttaatgataatttaatttgggcttttgaaatgttcttctacaaatgaaaaagatgtttaaaaacgttacaagggaagctatgccttctgaagtctatccttagttgaaacagaaaataaacacaaaggtacaagatccttaaattattttgaaccacagaggttgaaattgttttgtgatcttcagcagaaataaaatctgtacatgattttcttttatgccttttagtttacagtctttattagcaatttcagtgaatttgtagagcatagtaataggtatttactgtccacttatatatatcagcatctggtcatgcacgaaccattaattctatatttctatttcaataattctaatatattatttctataaatgtaatatctgtatgtggcaaagagcctttcttctcaagatcctgaaaagctggttacctgccctttgagtgccacagtcctgaactgcttgttcttgacatcttgcatattacttcagagttccccactgtgcagactctcaggtattaactgtaaaaaactctttacatgccattattatctgtaatctctatctcttctactttaaattaatgtttctagaattaataggttaaatacacatacacacacacaactatgcctcagaaaagttaggcttttacaaataaaaagaataagattagaattaacaagtagagagaataacggtaggcagagtcagaatcaggaataaatatcagtgaatcaaaagaatgaaaaatattatgtaataaaaattagcaatgtaatgtaaacgtttgataaaagagtatctttttcttttatctcttactgttgacctctgtgcactgtaataaggtgtgttgctggatcttcttggtcgaggtccttggtgaccttagtagtaataacagcattgctgacaccctaattgccctctgctggaacagaaggtagttttccagtgtaccagtcccttagtctatacagcacccttggtttaagcacacttgccatcatctggtatcctgctagactagaatctcttaaaagcaaattggttttctttcaaagaccaacttgactccaaagagagattcagaatcctacttctcctgctgctgcataaagaatctcaaccttcattttatttgaacacggaccaaagtgttcctgcttctgagttgtctgtaagctaattctgcagatgttccattcagatttaaagcttttttactgcataggatgtggataggaagcctaactattgtatctgatggcaaggcatatgttgcagccacagtactggctatggtccctttgctgaaacaagctacagaagcactgattcaagttgtgcttgtgcttgaacttttaatcttctagatttgtgaggatggctctttttccttcataatggattacaatgtaagcaagtcatggccatatactggagacgggctaaagctgcttttcccttaaagtaagtttcctacagataaggtatttatgagcactgagaaagtcaggacatgtactctaaatcacacagaatgttaattccacaggaaggcaatgccagacattgaaagaggatcacattcaacttttaatagtagttcaataacaaaaccttagcttttcaggaacaatgtgaagatacattagaattgccacatccatatcttcaaaacacgcaacctctgcaccctaataactgcttacggtataatcagtatgatgatgagattgagggggtctaaatttaagttccttatctcctgagttatgtgaaaatatccctcagtacaaaacatttgtgtgtttcacagatgactctcttgttttgccgtaatgctaccaagtttatggaaactagtcaactgaaggatttttctgttgtgttatgtgtaaatgtctgaacagtaaaatcatctgtgtattcctgtaacattcacgaagtatgaggaagtgggtttctccttgtttgatgtgagtggttttgcttgttgcatgggttccctgtgctttgtaacttgcatgaacacaaccaggtttctcaacaatgatttgtctgctgactcttttcagagatagtgaaggaaaaaaaatgtattaaaaccccaaattatctaggtttccaagtaggaaaaataaagatacatatgactttta

SEQ ID NO: 175840 - DNA, 690 bp, Homo sapiens
  Payload ID: 14527
  Gene Symbol: ARHGAP42
  Gene Name: Rho GTPase activating protein 42
  ENST ID: ENST00000531183
  CDS Start-End: 1-690
cttgaaaagcatttaaatttgtccgcaaagaaaaaggagtctcatttacaagaggcagatacacaaattgaccgagaacatcagaacttctatgaagcatcattagaatatgtctttaaaattcaagaggtccaagaaaaaaagaagtttgaatttgttgaaccgcttttgtcatttcttcagggcttatttactttttaccatgagggatatgaacttgcccaggaatttgcaccgtataagcaacagctgcagttcaacttgcagaatacaaggaataattttgaaagtactcgacaagaggtagagcggttgatgcaaaggatgaaatctgctaaccaggactacagaccacccagccagtggacgatggaaggctatctgtatgtccaggagaaacgaccgcttggttttacatggattaaacattattgtacatatgataagggaagtaaaacatttacaatgagtgtttcagaaatgaaatccagtgggaaaatgaatggccttgttactagctcaccggaaatgtttaaattaaaatcttgtatccgacgaaagacagattcaattgacaaacgattctgctttgacatagaagtagttgaaaggcatgggatcatcacgttacaggccttctcagaagctaataggaaactctggcttgaagccatggatgggaaggaaccg

SEQ ID NO: 175841 - DNA, 1843 bp, Homo sapiens
  Payload ID: 14527
  Gene Symbol: ARHGAP42
  Gene Name: Rho GTPase activating protein 42
  ENST ID: ENST00000529535
  CDS Start-End: 1-1331
aaacacctaatgcgatttctctcttattttcagtgtatttgaatgaagcagggttcaactttgtgagaaaatgcattcaagctgtggaaacaagaggtatcaccattttaggactctaccgaataggaggagtgaactccaaagttcaaaaactcatgaataccacattttctcctaaatcccctcctgatattgatattgatattgaactgtgggacaataagacgataacaagtgggctgaaaaactacctcaggtgccttgcagaaccactgatgacttacaagttgcacaaagattttatcattgctgttaaatctgatgatcaaaactacagggtggaggctgtacatgcattggtgcacaaattgccggagaaaaacagagagatgctggacatcttaataaagcatctggtcaaagtatcactacacagccaacaaaatctcatgactgtctcaaatcttggtgtcatatttggcccaactctaatgagagcacaggaagaaactgtggctgctatgatgaatattaaatttcagaatattgtggtagaaattctgatagagcactatgaaaagatttttcatactgctccagacccaagcattcctcttcctcagcctcagtctcgatctggatcccgaaggacacgagcaatctgcctctctacagggtctaggaagcccagagggaggtatactccatgcctggccgaacctgatagtgactcctatagcagcagcccagacagcacacctatggggagcattgagtcactctcttctcattcctctgaacaaaatagcactacaaagtcagcttcctgccagcccagggagaaatctggagggattccttggattgcaaccccatcatcttccaatggacagaaaagccttggtctgtggacaactagtcctgaatcaagttccagagaagatgcaaccaagacagatgcagaatcagactgccagagtgttgcttcagtcactagcccaggagacgtttccccacccatagacctagtcaagaaagagccttatgggctttcaggactgaaaagagcttctgcttcttctctcagatccatctctgcagctgaaggaaacaagagctacagtggatctattcaaagcttaacttctgtaggttccaaggagacacccaaagcttcaccaaacccagacctgcctccgaaaatgtgcaggagattaagactagacactgcctcaagcaatggctatcagcggcctggctcagtagtggcagcaaaagctcaactgtttgaaaatgttggttcacctaaaccagtttcttctgggcgctaacatttcctgagttatactactaagcatcagacatcgttcgtggagattttattgtgtctaggggagaagataaaaatatcagcaataataacaaaataccagatactaacaccatgcagacttgaagcaggaagatatgatagttccctgggcagctatttcagagaaggcctgaccttcagcaaagttcttgaaatttaagatgaacctgaagtacatggccatgtgaagatcaagaggaaaacatctcaggacatggacatagctggcctgagccaagccaaagccatgtactcctgtaaagcagagcacagtcatgagctttccttcccacaaggagcaatattttctaatgtgtacccatcagtggaaccaggatggttaaaggcaacttatgaaggcaaaacaggactagttccagaaaattatgttgtcttcctctaatactatttagtggatggcagtatcttcatggtatccatggtaacgaataaatgctatgattttatctg

SEQ ID NO: 175842 - DNA, 3001 bp, Homo sapiens
  Payload ID: 14528
  Gene Symbol: ARHGAP44
  Gene Name: Rho GTPase activating protein 44
  ENST ID: ENST00000262444
  CDS Start-End: 80-2404
gagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggccttaggaaaatccaaagcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagctgtgtgacatgagtggcgcagttttggatacgtgtgagggggattttcaggatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggt

SEQ ID NO: 175843 - DNA, 4211 bp, Homo sapiens
  Payload ID: 14528
  Gene Symbol: ARHGAP44
  Gene Name: Rho GTPase activating protein 44
  Uniprot ID: Q17R89
  ENST ID: ENST00000340825
  CDS Start-End: 301-2739
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctga

SEQ ID NO: 175844 - DNA, 4228 bp, Homo sapiens
  Payload ID: 14528
  Gene Symbol: ARHGAP44
  Gene Name: Rho GTPase activating protein 44
  Uniprot ID: Q17R89
  ENST ID: ENST00000379672
  CDS Start-End: 301-2757
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggccttaggaaaatccaaagcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctg

SEQ ID NO: 175845 - DNA, 2533 bp, Homo sapiens
  Payload ID: 14528
  Gene Symbol: ARHGAP44
  Gene Name: Rho GTPase activating protein 44
  ENST ID: ENST00000544416
  CDS Start-End: 80-1855
gagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggt

SEQ ID NO: 175846 - DNA, 4143 bp, Homo sapiens
  Payload ID: 14528
  Gene Symbol: ARHGAP44
  Gene Name: Rho GTPase activating protein 44
  ENST ID: ENST00000580768
  CDS Start-End: 300-836
actgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagctgtgtgacatgagtggcgcagttttggatacgtgtgagggggattttcaggatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctg

SEQ ID NO: 175847 - DNA, 730 bp, Homo sapiens
  Payload ID: 14528
  Gene Symbol: ARHGAP44
  Gene Name: Rho GTPase activating protein 44
  ENST ID: ENST00000583608
  CDS Start-End: 156-730
agtcagtgagatatgtgacatgagagaagcttctgtccagtccccgggggacatggctggtgttgagccttggttaaacctggcccttctaattttcttttagatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggccttaggaaaatccaaagcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccag

SEQ ID NO: 175848 - DNA, 629 bp, Homo sapiens
  Payload ID: 14528
  Gene Symbol: ARHGAP44
  Gene Name: Rho GTPase activating protein 44
  ENST ID: ENST00000581437
  CDS Start-End: 1-548
caggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacaggtaaccaagccacaggctccctcacttttttttatgaactttagtgaaatgtgcctaggggagggattgctagtgttactgccagtgaacacattcctgcgtgctttgggatgactgggctggca

SEQ ID NO: 175849 - DNA, 884 bp, Homo sapiens
  Payload ID: 14528
  Gene Symbol: ARHGAP44
  Gene Name: Rho GTPase activating protein 44
  ENST ID: ENST00000616670
  CDS Start-End: 48-398
ccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaattttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatgggtatgaactggtgtctctttctcagcactggggattaggggaggtggtgggggtggatgggtgacgcataagaaaaatacaattacgggaaggctgcactgactctcagcagtttaggtgactcgtagcaattaaactgtatctgc

SEQ ID NO: 175850 - DNA, 9604 bp, Homo sapiens
  Payload ID: 14529
  Gene Symbol: ARHGAP5
  Gene Name: Rho GTPase activating protein 5
  Uniprot ID: Q13017
  ENST ID: ENST00000345122
  CDS Start-End: 316-4824
ctcggtgagcgcgccgaggaagagaggcgagcggagagtggaggaggaggcggcggcggcgggagcggtccccaggaatgtcgctgccgccgccaccgccggggccgctgccgttgaggaggagacggaggagaccgacgttgttaggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtggatcattatcttagagaagttcaggcatttgcttcaaataaaaagaaccttcttgtagtggaaacatcagcacgatttaatgtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaaaacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagcagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtcaaaagtgcttttgtttctttgtttaatgtaatttttgtgcttcacctacaggatgctgcagtaaattaaatatcagtgaagcttctgatgtataaagaatgctatgaataaaacattaagaagctgtgtaattttaagttatagttgcctctatttttaccatttcattggtaaaaattagctaatttttttcaagtgaaatgaaaaataaaaatataaatttatcaatatgatggaaatcttattaaggagatgtattattgaattttcactgtacctgaaaaggagattcaaaattttttctggggatgtatataggtgaaaatttgattttttaaattatcaggaaaacaagataatgcacagatttctaagactaagatcttacctggatgtgatttttgagctgtggctagacattctttagagccactggaaatattttgaaaactattctagttatagcagagctgctaatattaacgaatatatttgtgtcttcatggtttgtgactattaggccaaattttgtggtatatgttgtcagtctggatctggtgaggtctgttcaacatgaatctttgtgttatcttgaatttagtagtttcaaggtacttaaattcttaacagtttctaatttgtttcaatacatatgggacatggttgatttttttactgtattagaactcttggaagttcttagccttttcaggttatgaaatacctgaaagtaaaattttctaagatttaataagggaagatactattcaaatcattttcttaggatagcatctttacatacaatgagaggattgtacaagcattaatctcatattccaacatccagttacttgatgtgatccaagtaccctggtctttttgaagcagttaaaatctaattaattaactttgggagtcttcactattcaattgatcctcatcattgtcctatttgcatgactccattttttcctccactatatgagttttctttgtcagggggagaggagtgggaagagtcacagaatctcatattcacatcttaattaaattgtgtgaaattagtcttttgtggaaattctgtaggcagtatgattttgaaaagctaaccaatgataattagcattttagttaatactaaatgcataaaattataacccttgaaattaatttggtgctggcagttctggtttagtcatttttaccagtagttagtagtattaagacctgcagtatatgcactttttgagtagctgtcaaataattgtagttgagaaacaacttgtttattctcacaattcagattttctattcagttttgtctcaaatagtaagttattgtgaacaatttaataacggccctcctgttctagtttgcctaatattttagttaagatttagtgttttaacctatttttttaagtttattttttgtattagattttatttgaataagttatgtgggtttagtaattgacctatttattcattgcttcactaattcatccagattagttttaagtgtgtatatgtatttgctcaccagatcattttcttgggaccttgaactgtgaatgttttgtcctaaccatttaatattttctaggtacttgctgcaagttcttgaactattttaccagctttaactttggggctcttagtttcttttctccagattcttgttattttattttatccaaataaatatttaggtgttctaagaa

SEQ ID NO: 175851 - DNA, 5786 bp, Homo sapiens
  Payload ID: 14529
  Gene Symbol: ARHGAP5
  Gene Name: Rho GTPase activating protein 5
  Uniprot ID: Q13017
  ENST ID: ENST00000396582
  CDS Start-End: 293-1006
agagaaatccgtcagcgcgagggagcccgagtggccgccattactgagcccggcgcggcggcgggcgctggggaaggggggagggacgggccgccgctggtggcggggagggagggagggagggtgggtgagctggctgcgggagccgtggggctcagggtttcggggcgtgtgtgtcggggagggcggggggaggtggctgaagggacgcgccgctcggtgagcgcgccgaggaagagaggcgagcggagagtggaggaggaggcggcggcggcgggagcggtccccaggaatgtcgctgccgccgccaccgccggggccgctgccgttgaggaggagacggaggagaccgacgttgttagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtcaaaagtgcttttgtttctttgtttaatgtaatttttgtgcttcacctacaggatgctgcagtaaattaaatatcagtgaagcttctgatgtataaagaatgctatgaataaaacattaagaagctgtgtaattttaagttatagttgcctctatttttaccatttcattggtaaaaattagctaatttttttcaagtgaaatgaaaaataaaaatataaatttatcaatatgatggaaatcttattaaggagatgtattattgaattttcactgtacctgaaaaggagattcaaaattttttctggggatgtatataggtgaaaatttgattttttaaattatcaggaaaacaagataatgcacagatttctaagactaagatcttacctggatgtgatttttgagctgtggctagacattctttagagccactggaaatattttgaaaactattctagttatagcagagctgctaatattaacgaatatatttgtgtcttcatggtttgtgactattaggccaaattttgtggtatatgttgtcagtctggatctggtgaggtctgttcaacatgaatctttgtgttatcttgaatttagtagtttcaaggtacttaaattcttaacagtttctaatttgtttcaatacatatgggacatggttgatttttttactgtattagaactcttggaagttcttagccttttcaggttatgaaatacctgaaagtaaaattttctaagatttaataagggaagatactattcaaatcattttcttaggatagcatctttacatacaatgagaggattgtacaagcattaatctcatattccaacatccagttacttgatgtgatccaagtaccctggtctttttgaagcagttaaaatctaattaattaactttgggagtcttcactattcaattgatcctcatcattgtcctatttgcatgactccattttttcctccactatatgagttttctttgtcagggggagaggagtgggaagagtcacagaatctcatattcacatcttaattaaattgtgtgaaattagtcttttgtggaaattctgtaggcagtatgattttgaaaagctaaccaatgataattagcattttagttaatactaaatgcataaaattataacccttgaaattaatttggtgctggcagttctggtttagtcatttttaccagtagttagtagtattaagacctgcagtatatgcactttttgagtagctgtcaaataattgtagttgagaaacaacttgtttattctcacaattcagattttctattcagttttgtctcaaatagtaagttattgtgaacaatttaataacggccctcctgttctagtttgcctaatattttagttaagatttagtgttttaacctatttttttaagtttattttttgtattagattttatttgaataagttatgtgggtttagtaattgacctatttattcattgcttcactaattcatccagattagttttaagtgtgtatatgtatttgctcaccagatcattttcttgggaccttgaactgtgaatgttttgtcctaaccatttaatattttctaggtacttgctgcaagttcttgaactattttaccagctttaactttggggctcttagtttcttttctccagattcttgttattttattttatccaaataaatatttaggtgttctaagaa

SEQ ID NO: 175852 - DNA, 5003 bp, Homo sapiens
  Payload ID: 14529
  Gene Symbol: ARHGAP5
  Gene Name: Rho GTPase activating protein 5
  ENST ID: ENST00000432921
  CDS Start-End: 317-4813
ctcggtgagcgcgccgaggaagagaggcgagcggagagtggaggaggaggcggcggcggcgggagcggtccccaggaatgtcgctgccgccgccaccgccggggccgctgccgttgaggaggagacggaggagaccgacgttgttagggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtggatcattatcttagagaagttcaggcatttgcttcaaataaaaagaaccttcttgtagtggaaacatcagcacgatttaatgtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaaaacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgatttgaaaatcgagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgact

SEQ ID NO: 175853 - DNA, 3047 bp, Homo sapiens
  Payload ID: 14529
  Gene Symbol: ARHGAP5
  Gene Name: Rho GTPase activating protein 5
  Uniprot ID: Q13017
  ENST ID: ENST00000433497
  CDS Start-End: 191-916
agagaggcgagcggagagtggaggaggaggcggcggcggcgggagcggtccccaggaatgtcgctgccgccgccaccgccggggccgctgccgttgaggaggagacggaggagaccgacgttgttagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttccc

SEQ ID NO: 175854 - DNA, 4881 bp, Homo sapiens
  Payload ID: 14529
  Gene Symbol: ARHGAP5
  Gene Name: Rho GTPase activating protein 5
  Uniprot ID: Q13017
  ENST ID: ENST00000539826
  CDS Start-End: 238-4746
ctgcgccgccgcgccgccgctccgcccccggtcgggtgtgtggctgcgcgcgccgggagagatgctgaggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtggatcattatcttagagaagttcaggcatttgcttcaaataaaaagaaccttcttgtagtggaaacatcagcacgatttaatgtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaaaacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagcagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactaga

SEQ ID NO: 175855 - DNA, 543 bp, Homo sapiens
  Payload ID: 14529
  Gene Symbol: ARHGAP5
  Gene Name: Rho GTPase activating protein 5
  ENST ID: ENST00000554090
  CDS Start-End: 133-543
agcgttattagaaatgcaagagagctggaggctcggggtgtagctgaggttgaaaggtgcacggaacagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaa

SEQ ID NO: 175856 - DNA, 654 bp, Homo sapiens
  Payload ID: 14529
  Gene Symbol: ARHGAP5
  Gene Name: Rho GTPase activating protein 5
  ENST ID: ENST00000556191
  CDS Start-End: 235-654
agcgttattagaaatgcaagagagctggaggctcggggtgtagctgaggttgaaaggtgcacggaagaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggctta

SEQ ID NO: 175857 - DNA, 4824 bp, Homo sapiens
  Payload ID: 14529
  Gene Symbol: ARHGAP5
  Gene Name: Rho GTPase activating protein 5
  Uniprot ID: Q13017
  ENST ID: ENST00000556611
  CDS Start-End: 256-4761
gcgcgcgtcccgtccaggctgcgccgccgcgccgccgctccgcccccggtcgggtgtgtggctgcgcgcgccgggagagatgctgaggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtggatcattatcttagagaagttcaggcatttgcttcaaataaaaagaaccttcttgtagtggaaacatcagcacgatttaatgtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaaaacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttca

SEQ ID NO: 175858 - DNA, 583 bp, Homo sapiens
  Payload ID: 14529
  Gene Symbol: ARHGAP5
  Gene Name: Rho GTPase activating protein 5
  ENST ID: ENST00000555814
  CDS Start-End: 473-583
actttcacagaacgtactgaatcaggggcctgcatccccgtgccgtgccgagccgacggagaaatggactcctcttctcgctcctgtggagtttcgtcttctggtacggtggtttgctcttgagttacgaccagaaaccggaacagaaggaaagggagaagcaggggaggttcggggacgacggcgctccgggcagtaaggcagtagcttccaaagcgtggaggatgggactgaggaggagcagaatacggagaaagagggaagctgaggaaaaatactcacgccaatgggtaaaagggaaaaggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttg

SEQ ID NO: 175859 - DNA, 872 bp, Homo sapiens
  Payload ID: 14529
  Gene Symbol: ARHGAP5
  Gene Name: Rho GTPase activating protein 5
  ENST ID: ENST00000557643
  CDS Start-End: 1-445
ctcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcc

SEQ ID NO: 175860 - DNA, 3946 bp, Homo sapiens
  Payload ID: 14530
  Gene Symbol: ARHGAP6
  Gene Name: Rho GTPase activating protein 6
  Uniprot ID: O43182
  ENST ID: ENST00000303025
  CDS Start-End: 312-2627
gcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatggggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaa

SEQ ID NO: 175861 - DNA, 5117 bp, Homo sapiens
  Payload ID: 14530
  Gene Symbol: ARHGAP6
  Gene Name: Rho GTPase activating protein 6
  Uniprot ID: O43182
  ENST ID: ENST00000337414
  CDS Start-End: 874-3798
ggctgggctgcgaatagcgtgttcctctccggcggaacacacacacccggccttggggctgtctcctgagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggccgcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccactgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaa

SEQ ID NO: 175862 - DNA, 2267 bp, Homo sapiens
  Payload ID: 14530
  Gene Symbol: ARHGAP6
  Gene Name: Rho GTPase activating protein 6
  ENST ID: ENST00000380717
  CDS Start-End: 1-1806
ttggagttgtatgatcttcagatcttaggcacaaaaccaccgatgaattccgatacacatcgtaactttgaccccaccgcaacccttagaaatcagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataac

SEQ ID NO: 175863 - DNA, 3632 bp, Homo sapiens
  Payload ID: 14530
  Gene Symbol: ARHGAP6
  Gene Name: Rho GTPase activating protein 6
  Uniprot ID: O43182
  ENST ID: ENST00000380718
  CDS Start-End: 874-3171
ggctgggctgcgaatagcgtgttcctctccggcggaacacacacacccggccttggggctgtctcctgagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggccgcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccactgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataac

SEQ ID NO: 175864 - DNA, 3883 bp, Homo sapiens
  Payload ID: 14530
  Gene Symbol: ARHGAP6
  Gene Name: Rho GTPase activating protein 6
  Uniprot ID: O43182
  ENST ID: ENST00000380736
  CDS Start-End: 248-2563
ccggctccgcagcggcagcgggacgctgtgccaggggcgctttgcacagcactcggcacgcacggagcagggctcgcgcccaggggctgccccaggatggcagtgaagtgcggggaactcagagagacaccgtgaccccaggctgagcccaaggcgcgccactcctcccggaggcgacatggggcacccggtgtaccgcggcgagaagccccagctgcactacgcgggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaag

SEQ ID NO: 175865 - DNA, 5303 bp, Homo sapiens
  Payload ID: 14530
  Gene Symbol: ARHGAP6
  Gene Name: Rho GTPase activating protein 6
  Uniprot ID: O43182
  ENST ID: ENST00000495242
  CDS Start-End: 874-2946
ggctgggctgcgaatagcgtgttcctctccggcggaacacacacacccggccttggggctgtctcctgagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggccgcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccactgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagttggagttgtatgatcttcagatcttaggcacaaaaccaccgatgaattccgatacacatcgtaactttgaccccaccgcaacccttagaaatcagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaacaagttctgtgcttccggctgcagtgcaggcctgcccacagtaccctgccagcatgtttacgccctgacctggagggaccagctaaggaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaa

SEQ ID NO: 175866 - DNA, 1487 bp, Homo sapiens
  Payload ID: 14531
  Gene Symbol: ARHGAP8
  Gene Name: Rho GTPase activating protein 8
  Uniprot ID: P85298
  ENST ID: ENST00000336963
  CDS Start-End: 97-1014
gggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataatgca

SEQ ID NO: 175867 - DNA, 1584 bp, Homo sapiens
  Payload ID: 14531
  Gene Symbol: ARHGAP8
  Gene Name: Rho GTPase activating protein 8
  Uniprot ID: P85298
  ENST ID: ENST00000356099
  CDS Start-End: 94-1395
ggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataa

SEQ ID NO: 175868 - DNA, 1474 bp, Homo sapiens
  Payload ID: 14531
  Gene Symbol: ARHGAP8
  Gene Name: Rho GTPase activating protein 8
  ENST ID: ENST00000389772
  CDS Start-End: 72-158
agctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataa

SEQ ID NO: 175869 - DNA, 1725 bp, Homo sapiens
  Payload ID: 14531
  Gene Symbol: ARHGAP8
  Gene Name: Rho GTPase activating protein 8
  Uniprot ID: P85298
  ENST ID: ENST00000389774
  CDS Start-End: 142-1536
acgtccggggaggggccaggtgagcggcagacccggcacgcaggtgggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaaagacggggatctcactatgtggcccaggctggtctcgaactccaagctcaagcgatcctcccacctcagcctcccaaagtactgggattacaggtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataa

SEQ ID NO: 175870 - DNA, 573 bp, Homo sapiens
  Payload ID: 14531
  Gene Symbol: ARHGAP8
  Gene Name: Rho GTPase activating protein 8
  ENST ID: ENST00000396119
  CDS Start-End: 182-573
agacccggcacgcaggtgggggccggcggggtccgtggccaggcatactctaccacctcccgctgggcccaggccttccccttggcacagttggagcagcctctgttatgagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaaagacggggatctcactatgtggcccaggctggtctcgaactccaagctcaagcgatcctcccacctcagcctcccaaagtactgggattacag

SEQ ID NO: 175871 - DNA, 581 bp, Homo sapiens
  Payload ID: 14531
  Gene Symbol: ARHGAP8
  Gene Name: Rho GTPase activating protein 8
  ENST ID: ENST00000412433
  CDS Start-End: 236-581
ccagggcgtgtacggggacaaggggccgctggccgggcatactctaccacctcccgctgggcccaggccttccccttggcacagttggagcagcctctgttatggtcttatttttctccctccatggtgctggacactggatgggcacttggtgtacaaccgagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagct

SEQ ID NO: 175872 - DNA, 768 bp, Homo sapiens
  Payload ID: 14531
  Gene Symbol: ARHGAP8
  Gene Name: Rho GTPase activating protein 8
  ENST ID: ENST00000447333
  CDS Start-End: 114-605
agacccggcacgcaggtgggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaaagacggtctcacccagccaccatggctcacacctgtaatcccagtactttgggaggccaaggtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaa

SEQ ID NO: 175873 - DNA, 2597 bp, Homo sapiens
  Payload ID: 14532
  Gene Symbol: ARHGAP9
  Gene Name: Rho GTPase activating protein 9
  Uniprot ID: Q9BRR9
  ENST ID: ENST00000393791
  CDS Start-End: 140-2335
ctccctgtttctgtcttgaacctgattctttcttcttatctccttcctgtgtccacctcaagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattttttctgatgca

SEQ ID NO: 175874 - DNA, 2912 bp, Homo sapiens
  Payload ID: 14532
  Gene Symbol: ARHGAP9
  Gene Name: Rho GTPase activating protein 9
  ENST ID: ENST00000393797
  CDS Start-End: 194-2659
gctggaagcaacagatggggactgcagaggaggtggtggtattgggatagtgctgcagccaagaacttaacgactgaaagtaactgggatatcttcataattatctgaaggtcacagtgggagaacaaaattaaaagaactgagaagacttacaagagaacctcctaagagtcacccaaacaatcggctgagaatgagaagaggttcaagtgattcttgtgcctcaggctcccaagtagctgggactacagtagctgggccagcacacccagaaagcctcacattgtgcagtggagaagctgagagaagaggaaaagaggagtggccagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggttagatgggtggaggcccggagggaggctccgaccggccgggaccaagggagtggggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattttt

SEQ ID NO: 175875 - DNA, 2569 bp, Homo sapiens
  Payload ID: 14532
  Gene Symbol: ARHGAP9
  Gene Name: Rho GTPase activating protein 9
  Uniprot ID: Q9BRR9
  ENST ID: ENST00000424809
  CDS Start-End: 227-2149
acatacttcctcaccagacaccaccaggagttctcagcccccaaaacctgtcaccgatcctcaccaggctgtttgctctaccctctcccccaactcaagggctcccgtcctcacctccctgcaacactgctcctagaaccatgtctgtctacctggagacagccaggcctattcccttctgggtctccagtgtccctttttctcacaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattttt

SEQ ID NO: 175876 - DNA, 2323 bp, Homo sapiens
  Payload ID: 14532
  Gene Symbol: ARHGAP9
  Gene Name: Rho GTPase activating protein 9
  Uniprot ID: Q9BRR9
  ENST ID: ENST00000430041
  CDS Start-End: 433-2076
gtgctcttccttcctccagactcctagcccagggcagggtttttctgtgttctgcttgcctgataggctacagcaggtctcctctagagatgtgacttgcccagcccttccctctctttcttaaccgtgggtggaaaggggctcctcttcccttctgtagacccttctctgtcttcttttaccttgcaggatgtgagggtggggcacccccttcaacattccccccaccccacaaaaagcctgttcccctttcctgtggccctgaggtgggggtggggtgggggaggcgggaagttggcaacaggaagtgaggagaagagcaaagaaaactgtgagagagagaatttttaaaaagcagctggggcctgaggtttctcccccagtaccctgggtcacctcagcccagagctggcggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggt

SEQ ID NO: 175877 - DNA, 533 bp, Homo sapiens
  Payload ID: 14532
  Gene Symbol: ARHGAP9
  Gene Name: Rho GTPase activating protein 9
  ENST ID: ENST00000551452
  CDS Start-End: 12-533
gtgagaagacaatgggggagggagcaggaggtgggaaggccaagagaagcatgggaagggcaacaggcagaatgaccacctccttcttcccccttttctggcaggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccat

SEQ ID NO: 175878 - DNA, 568 bp, Homo sapiens
  Payload ID: 14532
  Gene Symbol: ARHGAP9
  Gene Name: Rho GTPase activating protein 9
  ENST ID: ENST00000552249
  CDS Start-End: 143-568
gtcattaaccttgtgtctccctgtttctgtcttgaacctgattctttcttcttatctccttcctgtgtccacctcaagactcccaccactacccaggaccaactcctgctcctgaatcttctgatgggccccacaagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggac

SEQ ID NO: 175879 - DNA, 722 bp, Homo sapiens
  Payload ID: 14532
  Gene Symbol: ARHGAP9
  Gene Name: Rho GTPase activating protein 9
  ENST ID: ENST00000550399
  CDS Start-End: 1-470
gggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtatttt

SEQ ID NO: 175880 - DNA, 504 bp, Homo sapiens
  Payload ID: 14532
  Gene Symbol: ARHGAP9
  Gene Name: Rho GTPase activating protein 9
  ENST ID: ENST00000550130
  CDS Start-End: 1-504
cgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacac

SEQ ID NO: 175881 - DNA, 624 bp, Homo sapiens
  Payload ID: 14532
  Gene Symbol: ARHGAP9
  Gene Name: Rho GTPase activating protein 9
  ENST ID: ENST00000552066
  CDS Start-End: 231-624
ctttccaggaaggaccaagcggaagatccctctcccaggaagacttgccgtcagaagccagtgccagcacagtgagtcacagctcttctgagctgggccctgttctaggcacaggacagacagcacctctgtcttcaggggactcccctggggatgacaaacacaaaaacaaataaataagataacgcttggtactactgataagtctaaaggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagc

SEQ ID NO: 175882 - DNA, 967 bp, Homo sapiens
  Payload ID: 14532
  Gene Symbol: ARHGAP9
  Gene Name: Rho GTPase activating protein 9
  ENST ID: ENST00000548139
  CDS Start-End: 78-967
ggctcctcttcccttctgtagacccttctctgtcttcttttaccttgcaggatgtgagggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctc

SEQ ID NO: 175883 - DNA, 563 bp, Homo sapiens
  Payload ID: 14532
  Gene Symbol: ARHGAP9
  Gene Name: Rho GTPase activating protein 9
  ENST ID: ENST00000549602
  CDS Start-End: 381-563
gttctgcttgcctgataggctacagcaggtctcctctagagatgtgacttgcccagcccttccctctctttcttaaccgtgggtggaaaggggctcctcttcccttctgtagacccttctctgtcttcttttaccttgcaggatgtgagggtggggcacccccttcaacattccccccaccccacaaaaagcctgttcccctttcctgtggccctgaggtgggggtggggtgggggaggcgggaagttggcaacaggaagtgaggagaagagcaaagaaaactgtgagagagagaatttttaaaaagcagctggggcctgaggtttctcccccagtaccctgggtcacctcagcccagagctggcggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccg

SEQ ID NO: 175884 - DNA, 565 bp, Homo sapiens
  Payload ID: 14532
  Gene Symbol: ARHGAP9
  Gene Name: Rho GTPase activating protein 9
  ENST ID: ENST00000552604
  CDS Start-End: 108-565
aaaactgtgagagagagaatttttaaaaagcagctggggcctgaggtttctcccccagtaccctgggtcacctcagcccagagctggcggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacaggaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgcc

SEQ ID NO: 175885 - DNA, 2818 bp, Homo sapiens
  Payload ID: 14532
  Gene Symbol: ARHGAP9
  Gene Name: Rho GTPase activating protein 9
  ENST ID: ENST00000550288
  CDS Start-End: 152-2362
atatcttcataattatctgaaggtcacagtgggagaacaaaattaaaagaactgagaagacttacaagagaacctcctaagagtcacccaaacaatcggctgagaatgagaagagggtcttgctctgtcacctaggctggagtgcagtggcatgatctcagctcagtgcaatctctgcctcccaggttcaagtgattcttgtgcctcaggctcccaagtagctgggactacagtagctgggccagcacacccagaaagcctcacattgtgcagtggagaagctgagagaagaggaaaagaggagtggccagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattt

SEQ ID NO: 175886 - DNA, 3171 bp, Homo sapiens
  Payload ID: 14533
  Gene Symbol: ARHGEF1
  Gene Name: Rho guanine nucleotide exchange factor (GEF) 1
  Uniprot ID: Q92888
  ENST ID: ENST00000337665
  CDS Start-End: 21-2804
cttcggttccggtggcggcgatggcttctctttccacctggagcagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaagaga

SEQ ID NO: 175887 - DNA, 3091 bp, Homo sapiens
  Payload ID: 14533
  Gene Symbol: ARHGEF1
  Gene Name: Rho guanine nucleotide exchange factor (GEF) 1
  Uniprot ID: Q92888
  ENST ID: ENST00000347545
  CDS Start-End: 85-2724
ccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaagaga

SEQ ID NO: 175888 - DNA, 3243 bp, Homo sapiens
  Payload ID: 14533
  Gene Symbol: ARHGEF1
  Gene Name: Rho guanine nucleotide exchange factor (GEF) 1
  Uniprot ID: Q92888
  ENST ID: ENST00000354532
  CDS Start-End: 149-2887
gggggcctccggaaaaacgccccgacttcctgccccgccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattat

SEQ ID NO: 175889 - DNA, 2986 bp, Homo sapiens
  Payload ID: 14533
  Gene Symbol: ARHGEF1
  Gene Name: Rho guanine nucleotide exchange factor (GEF) 1
  Uniprot ID: Q92888
  ENST ID: ENST00000378152
  CDS Start-End: 99-2945
gggcgcaaaggtggactcagggcggctagagcgacgcggcggcaggggtggggagagtgcggagcccgagcgcggaggcttcggttccggtggcggcgatggcttctctttccacctggagcagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaagaga

SEQ ID NO: 175890 - DNA, 428 bp, Homo sapiens
  Payload ID: 14533
  Gene Symbol: ARHGEF1
  Gene Name: Rho guanine nucleotide exchange factor (GEF) 1
  ENST ID: ENST00000600517
  CDS Start-End: 1-206
aggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgctggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaaggtagcccagctctgcccc

SEQ ID NO: 175891 - DNA, 2636 bp, Homo sapiens
  Payload ID: 14533
  Gene Symbol: ARHGEF1
  Gene Name: Rho guanine nucleotide exchange factor (GEF) 1
  ENST ID: ENST00000599589
  CDS Start-End: 1-2108
gaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagaaggtggaagaggctatcagggcgtctggggcgctcagagagcctgcgggtgagtgaccgccgccggccttcccggggcagcctcggggctaagggccggggtgggggccgctcccggagcgacgtggacatggaccccagttccgccacggcagtgcttggccctgcccgacgagccacccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaaggagttggaggaggaattttgccgcctgagacccctcctgtctcagcttggggggaactctgtcccccagcctggctgcacttgaggttcccgcccaggaagcaccccatcctcaccaccacctgtgaggtaggaactgccatgatggatgcccatttcacagatgtggaaactgaggttctgacaggaaaagtaacttggccaaagtcccacagggatgaggtgagcctggacttgaatgcaggcgcgaggtggaggtggcgacgatgcgtccaggacccctgctggacacgcaagcctggaccgggactggaacacggacccgcacacacgcagcctggataggagatacacggacagagggacatatggatacagtcaggctccgccccgccaagtcccacaccaccttctctggggaaaggcagctctcacctgggcagcccctggaggcttctacccctagaggggaaaataggtctcacggcaagacagcagtccccaggtggatattcaggggccaggacagctctgtcggatctcaccaaccccaccagcgcccaggtgctgagaccgaggtgctgagaggctagaagagaacttcagccctgcctgacagagaaggttcagcctcactcccgctcaccactcactcaggcaagtcgctaaacatccccgagcctcaagtttcctcatctgcaaaatgggacaataatgacctccctcctagagtggttgggaaggttaaaccgcagggcgcatggagcacagctggtactgcaccaagtaccaagtaaacacgcatttgctgtgagcttgctgcttccgaataatctcattaaaaatattaagaattttgccagataacaagaa

SEQ ID NO: 175892 - DNA, 919 bp, Homo sapiens
  Payload ID: 14533
  Gene Symbol: ARHGEF1
  Gene Name: Rho guanine nucleotide exchange factor (GEF) 1
  ENST ID: ENST00000594258
  CDS Start-End: 1-919
cacctctgtccctgccctggtctctccccgtctctgtccctgtcctggtttctcttcgtctctgttcttgtcttggtctctccttgtctctgtccccggcatctgcctgactctgtccttggcctcggggtccaggctatcagggcgtctggggcgctcagagagcctgcgggtgagtgaccgccgccggccttcccggggcagcctcggggctaagggccggggtgggggccgctcccggagcgacgtggacatggaccccagttccgccacggcagtgcttggccctgcccgacgagccacccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacaca

SEQ ID NO: 175893 - DNA, 826 bp, Homo sapiens
  Payload ID: 14533
  Gene Symbol: ARHGEF1
  Gene Name: Rho guanine nucleotide exchange factor (GEF) 1
  ENST ID: ENST00000594521
  CDS Start-End: 1-826
ttcttccggaaaaaggtgatggggaaccggcggtcggacgagcctgccaagaccaagaaggggctgagcagcatcctggatgccgcccgctggaaccggggagagccccaggccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagaaggtggaagaggctatcagggcgtctggggcgctcagagagcctgcgggtgagtgaccgccgccggccttcccggggcagcctcggggctaagggccggggtgggggccgctcccggagcgacgtggacatggaccccagttccgccacggcagtgcttggccctgcccgacgagccacccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgc

SEQ ID NO: 175894 - DNA, 3393 bp, Homo sapiens
  Payload ID: 14533
  Gene Symbol: ARHGEF1
  Gene Name: Rho guanine nucleotide exchange factor (GEF) 1
  ENST ID: ENST00000599846
  CDS Start-End: 126-3032
gacttcctgccccgccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagaggctatcagggcgtctggggcgctcagagagcctgcgggtgagtgaccgccgccggccttcccggggcagcctcggggctaagggccggggtgggggccgctcccggagcgacgtggacatggaccccagttccgccacggcagtgcttggccctgcccgacgagccacccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaag

SEQ ID NO: 175895 - DNA, 769 bp, Homo sapiens
  Payload ID: 14533
  Gene Symbol: ARHGEF1
  Gene Name: Rho guanine nucleotide exchange factor (GEF) 1
  ENST ID: ENST00000594417
  CDS Start-End: 1-385
ccccatcctcaccaccacctgtgaggtaggaactgccatgatggatgcccatttcacagatgtggaaactgaggttctgacaggaaaagtaacttggccaaagtcccacagggatgaggtgagcctggacttgaatgcagtggacgcgcggacaaacggacaggcgcgaggtggaggtggcgacgatgcgtccaggacccctgctggacacgcaagcctggaccgggactggaacacggacccgcacacacgcagcctggataggagatacacggacagagggacatatggatacagtcaggctccgccccgccaagtcccacaccaccttctctggggaaaggcagctctcacctgggcagcccctggaggcttctacccctagaggggaaaataggtctcacggcaagacagcagtccccaggtggatattcaggggccaggacagctctgtcggatctcaccaaccccaccagcgcccaggtgctgagaccgaggtgctgagaggctagaagagaacttcagccctgcctgacagagaaggttcagcctcactcccgctcaccactcactcaggcaagtcgctaaacatccccgagcctcaagtttcctcatctgcaaaatgggacaataatgacctccctcctagagtggttgggaaggttaaaccgcagggcgcatggagcacagctggtactgcaccaagtaccaagtaaacacgcatttgctgtgagcttgctgcttccgaataatctcattaaaaatatta

SEQ ID NO: 175896 - DNA, 872 bp, Homo sapiens
  Payload ID: 14533
  Gene Symbol: ARHGEF1
  Gene Name: Rho guanine nucleotide exchange factor (GEF) 1
  ENST ID: ENST00000595723
  CDS Start-End: 1-872
cccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaacacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcac

SEQ ID NO: 175897 - DNA, 588 bp, Homo sapiens
  Payload ID: 14533
  Gene Symbol: ARHGEF1
  Gene Name: Rho guanine nucleotide exchange factor (GEF) 1
  ENST ID: ENST00000598812
  CDS Start-End: 1-265
tgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcagacagcaaccctgagatgtatcctgggtggatggggaccccaggcctagcaaatatgtcacaaacatctctcttcctcctacagacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccg

SEQ ID NO: 175898 - DNA, 5590 bp, Homo sapiens
  Payload ID: 14534
  Gene Symbol: ARHGEF10
  Gene Name: Rho guanine nucleotide exchange factor (GEF) 10
  Uniprot ID: O15013
  ENST ID: ENST00000349830
  CDS Start-End: 186-4220
ggggtcgcgggggacgcgggggacgcgggggacggcggggaacggcgggggacggcggggaacagcgggggacggcggggaacagcgggggacggcggggaacagcaggggactgcgggtcgcgtcctggccgccgaggagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatgtgaatactaaatgttaaacttcatcagcgtcagacctattgtatcatattagagaatttgcagactaagaatttatgagaaaatatatgtattcagtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcaggcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttatttt

SEQ ID NO: 175899 - DNA, 2221 bp, Homo sapiens
  Payload ID: 14534
  Gene Symbol: ARHGEF10
  Gene Name: Rho guanine nucleotide exchange factor (GEF) 10
  ENST ID: ENST00000398560
  CDS Start-End: 488-1630
aggtgtagtaccagcctctcagtttggcagcgttcctcttggctcgcacggtgtttcttcaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagcagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaaatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaaggttgagagaggttttcttcaactctattccaaaattatttttgctttgtgctaataagctgtcgttgtccagcaatactaatcttttggatcgtttggagtaattcccttcgcccagagttcttaaccggggtggatggaggccttcgggagagtcacaccaatgtggaaattgtatgtaaaaccttaacagcctgtcttaacagcattttcttaggaaagagattcatacattcattagaccctcaaatggatccaggacctcccaaggggttaagagcaactcctttagcttacttttcctttcaaaataacggtatttaatttcagatagtaatagttaaagctgaaaatatttacaggctaggcacagtggctcacacctgtaagcccagcactttgggaggctgaggtgggaagatcgctggaacccaggagttcaagaccagcctgggcatgatagtgagaacccatatctaaaaaaagaaaaaaaaaatagctgggcacagtggcatgcacctatatagtctgagctacgtgggaggctgaggccagaggattgctcgagcctgggaggtccaggctgtggtgagctgttattgaggtgctgcactctagcctgggtgatggagcaaaaccctgtttc

SEQ ID NO: 175900 - DNA, 5480 bp, Homo sapiens
  Payload ID: 14534
  Gene Symbol: ARHGEF10
  Gene Name: Rho guanine nucleotide exchange factor (GEF) 10
  Uniprot ID: O15013
  ENST ID: ENST00000398564
  CDS Start-End: 1-4110
atgagacctccaggatttctcagcagagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagcagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatgtgaatactaaatgttaaacttcatcagcgtcagacctattgtatcatattagagaatttgcagactaagaatttatgagaaaatatatgtattcagtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcaggcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttatttt

SEQ ID NO: 175901 - DNA, 4343 bp, Homo sapiens
  Payload ID: 14534
  Gene Symbol: ARHGEF10
  Gene Name: Rho guanine nucleotide exchange factor (GEF) 10
  ENST ID: ENST00000522435
  CDS Start-End: 1-2967
gcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatgtgaatactaaatgttaaacttcatcagcgtcagacctattgtatcatattagagaatttgcagactaagaatttatgagaaaatatatgtattcagtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcaggcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatg

SEQ ID NO: 175902 - DNA, 5472 bp, Homo sapiens
  Payload ID: 14534
  Gene Symbol: ARHGEF10
  Gene Name: Rho guanine nucleotide exchange factor (GEF) 10
  Uniprot ID: O15013
  ENST ID: ENST00000520359
  CDS Start-End: 174-4094
gacgcgggggacgcgggggacggcggggaacggcgggggacggcggggaacagcgggggacggcggggaacagcgggggacggcggggaacagcaggggactgcgggtcgcgtcctggccgccgaggagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagcagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaaatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatgtgaatactaaatgttaaacttcatcagcgtcagacctattgtatcatattagagaatttgcagactaagaatttatgagaaaatatatgtattcagtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcaggcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgca

SEQ ID NO: 175903 - DNA, 5648 bp, Homo sapiens
  Payload ID: 14534
  Gene Symbol: ARHGEF10
  Gene Name: Rho guanine nucleotide exchange factor (GEF) 10
  Uniprot ID: O15013
  ENST ID: ENST00000518288
  CDS Start-End: 164-4270
gaacggcgggggacggcggggaacagcgggggacggcggggaacagcgggggacggcggggaacagcaggggactgcgggtcgcgtcctggccgccgagcatttatttgctggctttagcagccaacatcggcagttacggatgcataactctttatagacagatgagacctccaggatttctcagcagagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagcagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatgtgaatactaaatgttaaacttcatcagcgtcagacctattgtatcatattagagaatttgcagactaagaatttatgagaaaatatatgtattcagtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcaggcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgca

SEQ ID NO: 175904 - DNA, 2221 bp, Homo sapiens; identical to SEQ ID NO: 175899
  Payload ID: 14534
  Gene Symbol: ARHGEF10
  Gene Name: Rho guanine nucleotide exchange factor (GEF) 10
  ENST ID: ENST00000616718
  CDS Start-End: 488-1630

SEQ ID NO: 175905 - DNA, 5590 bp, Homo sapiens; identical to SEQ ID NO: 175898
  Payload ID: 14534
  Gene Symbol: ARHGEF10
  Gene Name: Rho guanine nucleotide exchange factor (GEF) 10
  Uniprot ID: O15013
  ENST ID: ENST00000619613
  CDS Start-End: 186-4220

SEQ ID NO: 175906 - DNA, 5480 bp, Homo sapiens; identical to SEQ ID NO: 175900
  Payload ID: 14534
  Gene Symbol: ARHGEF10
  Gene Name: Rho guanine nucleotide exchange factor (GEF) 10
  Uniprot ID: O15013
  ENST ID: ENST00000610399
  CDS Start-End: 1-4110

SEQ ID NO: 175907 - DNA, 5472 bp, Homo sapiens; identical to SEQ ID NO: 175902
  Payload ID: 14534
  Gene Symbol: ARHGEF10
  Gene Name: Rho guanine nucleotide exchange factor (GEF) 10
  Uniprot ID: O15013
  ENST ID: ENST00000631758
  CDS Start-End: 174-4094

SEQ ID NO: 175908 - DNA, 4343 bp, Homo sapiens; identical to SEQ ID NO: 175901
  Payload ID: 14534
  Gene Symbol: ARHGEF10
  Gene Name: Rho guanine nucleotide exchange factor (GEF) 10
  ENST ID: ENST00000634038
  CDS Start-End: 1-2967

SEQ ID NO: 175909 - DNA, 5648 bp, Homo sapiens; identical to SEQ ID NO: 175903
  Payload ID: 14534
  Gene Symbol: ARHGEF10
  Gene Name: Rho guanine nucleotide exchange factor (GEF) 10
  Uniprot ID: O15013
  ENST ID: ENST00000633616
  CDS Start-End: 164-4270

SEQ ID NO: 175910 - DNA, 3018 bp, Homo sapiens
  Payload ID: 14535
  Gene Symbol: ARHGEF10L
  Gene Name: Rho guanine nucleotide exchange factor (GEF) 10-like
  Uniprot ID: Q9HCE6
  ENST ID: ENST00000167825
  CDS Start-End: 1-1836
aagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccagacaggtcattaataaaatgttctccaagagcctgagctttttaaagttgtatatctccagatagatggcttgggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgg

SEQ ID NO: 175911 - DNA, 4488 bp, Homo sapiens
  Payload ID: 14535
  Gene Symbol: ARHGEF10L
  Gene Name: Rho guanine nucleotide exchange factor (GEF) 10-like
  Uniprot ID: Q9HCE6
  ENST ID: ENST00000361221
  CDS Start-End: 160-3999
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagcctgccaaccacaggggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgga

SEQ ID NO: 175912 - DNA, 3685 bp, Homo sapiens
  Payload ID: 14535
  Gene Symbol: ARHGEF10L
  Gene Name: Rho guanine nucleotide exchange factor (GEF) 10-like
  ENST ID: ENST00000375408
  CDS Start-End: 39-3197
attaatagccgtggcagggctcgaatcacaggccaagaatgttacccagcagctcgtgggggaagaggaagctgcgaggcaggctggggtgggtgcggagtgatgcccggggcgtgatgtgggcccggcaggagggtctgcaccacccccacccccacgccgtcatccgctgtccctcctcctcctcctcctctgtctcctgctcaggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgg

SEQ ID NO: 175913 - DNA, 4035 bp, Homo sapiens
  Payload ID: 14535
  Gene Symbol: ARHGEF10L
  Gene Name: Rho guanine nucleotide exchange factor (GEF) 10-like
  Uniprot ID: Q9HCE6
  ENST ID: ENST00000375415
  CDS Start-End: 44-3766
gtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagcctgccaaccacaggggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctg

SEQ ID NO: 175914 - DNA, 5788 bp, Homo sapiens
  Payload ID: 14536
  Gene Symbol: ARHGEF11
  Gene Name: Rho guanine nucleotide exchange factor (GEF) 11
  Uniprot ID: O15085
  ENST ID: ENST00000361409
  CDS Start-End: 744-5312
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacaggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagctgaggtggcaggcagcaaggttgtccctgcactaccagagagtggccagtcagagcctgggccacctgaagtggaaggcggaacaaaggctacggggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgt

SEQ ID NO: 175915 - DNA, 6889 bp, Homo sapiens
  Payload ID: 14536
  Gene Symbol: ARHGEF11
  Gene Name: Rho guanine nucleotide exchange factor (GEF) 11
  Uniprot ID: O15085
  ENST ID: ENST00000368194
  CDS Start-End: 1041-5729
agcgaaatctccgtttcatggaggctgaggcaagagaaaatttcggagcctggatgtggaggagcccaacagcagaactaactcaggaaattgtctttcagaaaaaggccgaacgtaggctgggtctgagaatcaggctggggtaggtggaggaacctgcaagtttaaaggaaaaagaaaaggagagaatattttcagagattatctctggtttgttatcattactaccatcttaaaggtaaaaagcattgcatttcaggtgttctttgatttttattttatttttttttttggtgcaattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagctgaggtggcaggcagcaaggttgtccctgcactaccagagagtggccagtcagagcctgggccacctgaagtggaaggcggaacaaaggctacggggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttca

SEQ ID NO: 175916 - DNA, 6891 bp, Homo sapiens
  Payload ID: 14537
  Gene Symbol: ARHGEF12
  Gene Name: Rho guanine nucleotide exchange factor (GEF) 12
  Uniprot ID: Q9NZN5
  ENST ID: ENST00000356641
  CDS Start-End: 331-4908
tcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaa

SEQ ID NO: 175917 - DNA, 9660 bp, Homo sapiens
  Payload ID: 14537
  Gene Symbol: ARHGEF12
  Gene Name: Rho guanine nucleotide exchange factor (GEF) 12
  Uniprot ID: Q9NZN5
  ENST ID: ENST00000397843
  CDS Start-End: 167-4801
gttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 175918 - DNA, 8753 bp, Homo sapiens
  Payload ID: 14537
  Gene Symbol: ARHGEF12
  Gene Name: Rho guanine nucleotide exchange factor (GEF) 12
  ENST ID: ENST00000532993
  CDS Start-End: 471-4796
cttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaa

SEQ ID NO: 175919 - DNA, 4159 bp, Homo sapiens
  Payload ID: 14538
  Gene Symbol: ARHGEF15
  Gene Name: Rho guanine nucleotide exchange factor (GEF) 15
  Uniprot ID: O94989
  ENST ID: ENST00000361926
  CDS Start-End: 111-2636
cctcgctccaaggggcagacaggacaggctgaaaatagcaactggttccaaaaagataaaggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctccagtccccccacccaagccgtctgggtcaccctgcacgcctctgctccccatggctggagtcctggctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccagatgctggcctggcctgccctccctgctgcccctgtgtctgccacaccacccggcctggcctggagctcagatgggtgcctgtggggggctatgaggaggtccccagggtcccccgtcgggcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggggacagtcctgatgaagctcctcagaatactcctccagcaactgtggaggggagggaagaggaggggctagaggtgctgaaggagcagaattgggagctgcccctgcaggatgaacctctgtaccagacctaccgagcagccgtgctgtcagaggagctgtggggggtgggtgaggatgggagtccttctccagcaaatgctggagatgcacccaccttcccacgaccccctggacctcgcaacaccctgtggcaggagcttccggctgtgcaagccagcggtcttctggataccctcagcccccaggagaggcgcatgcaggagagtcttttcgaggtggtgacgtccgaggcttcctacctgcgctccctgcggctgctgaccgacaccttcgtgctgagccaggcactccgggacacgctcaccccccgtgatcaccacacactcttctccaatgtgcagcgagtccagggagtcagcgagcggtttctagcaacgctcctgtcccgtgtgcgctcttccccccacatcagcgacttgtgtgatgtggtgcatgcccacgctgtggggcctttctcggtgtatgtggattatgtgcggaaccagcagtatcaggaggagacctacagccgcctcatggacaccaacgtgcgcttctccgccgagctgcgccggctgcagagcctccctaagtgtgagcggctcccgctgccgtccttcctgctactgcccttccagcgcatcacccggctgcgcatgctgctgcagaatatcctgcgccagacagaagaggggtccagccgtcaggagaatgcccagaaggccctgggtgctgtcagcaagatcatcgagcgttgcagcgctgaggtggggcgcatgaagcagactgaagagctgatccggctcacccaaaggctgcgcttccacaaagtcaaggccctgcccctggtctcctggtcacggcgcctggaattccagggagagctgactgagttagggtgccggagggggggcgtgctctttgcctcgcgcccccgcttcacccctctttgcctgctgctctttagcgacctgctgctcatcactcagcctaagagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctatcagacatgcagcgctggctgggagccttcccaaccccaggcccccttccctgctccccagacaccatctatgaggactgtgactgttcccaggaactgtgttcagagtcgtctgcacctgccaagactgaaggacggagtctggagtccagggctgcccccaaacacctgcacaagacccctgaaggttggctgaaggggcttcctggggccttccctgcccagctggtgtgtgaagtcacaggggaacacgaaaggaggaggcaccttcgccagaaccagaggcttctcgaggctgttggatcttcttcaggcacccccaatgcccccccaccctaatgcaggctgaggagggggcacatgttgggagacacctaccagtgtggcacggagagaacaaagcccattcatccattggattcactgtcagtggagatactacctctcgtggcaaccatagagatcgagcttcaggacagagcagccaatgaaaacggccgcctgaacccacagcaataagaatgaatgaggatgccttgaatgtgtggccaatggagacagaggcttagtgcagagcagccaatgggtactgagctggctgagcctatggccaatgagtattcctgctatgctcagggccaaggaagacaaatctaggtcatggcagttgaaaaagggcctcattggagataaagtcgtaggataaaattgggaacaggaatgagcaggaagccaatcagccaaagaaaatggtgatctggacccaagagaccagtagtcaccctgcttgtttctgcagcaatgactggtcctgtcttttgagtctgggaaatactagtttccattcctggatgcttcctgtgccctctcaagccagttcttctcttccagaagaattcagagtatgtgtctcagaaaatctgtgtgtgtacatgtgcatgtgtagatatgtgtgtatatgtatcaggaaaggcattctgctgactgtggtgtgtgtgtggtgattgtgctcctgacccacaaatgactgagtgctccatttcttcctttaccccccatttttcctattattcgctccaagaaagatgctaagtctgagctccagaagagactgtgctgggtgtggcttggcacccaggggatgagagccctgagctttgggtctcttggaggctagggttctgtggcagttgcagggcaatgttatggagcagccaacggcctggcagaggagcccaagggactgaagatggccagtagctgggtcctgaggcccctgaagtctgcagacccttctccttgccccaaacactggcctccataattcctgcctgcagatctcccaacttgaactataatccaccagccagcctcagccttgagctttggaaccacattagatcctgcatctgggtgaagaaacgggagctgtggaccacaggccagccagtgaacctcctgggctttcttgcctttgtcctgatcctctcacagaaacactgggccaaacagtggggagagattggagagcgggtgtggctgcccaaccccatccagagcatctgcttccagatgagccagtgcctcgcatgataccagaggaggcgagggacagagacagcaaggcagacagtggctggcaggggggcccaggcccgggacgaggcctccccttcagctcaggcacagcaacttgcccaggactgacactgtcaccctgactgcaggaggcacagggactccgggagactcagagggcgaagagcactggcatttggcatgtccatgacattggagactcccctagcagggtgcctgacgtgtggggaaccctcagtaaatagtggtgcatttgtattgag

SEQ ID NO: 175920 - DNA, 4138 bp, Homo sapiens
  Payload ID: 14538
  Gene Symbol: ARHGEF15
  Gene Name: Rho guanine nucleotide exchange factor (GEF) 15
  Uniprot ID: O94989
  ENST ID: ENST00000421050
  CDS Start-End: 92-2617
actcagccctgggaggtgactgagagtggaggggattcaagggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctccagtccccccacccaagccgtctgggtcaccctgcacgcctctgctccccatggctggagtcctggctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccagatgctggcctggcctgccctccctgctgcccctgtgtctgccacaccacccggcctggcctggagctcagatgggtgcctgtggggggctatgaggaggtccccagggtcccccgtcgggcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggggacagtcctgatgaagctcctcagaatactcctccagcaactgtggaggggagggaagaggaggggctagaggtgctgaaggagcagaattgggagctgcccctgcaggatgaacctctgtaccagacctaccgagcagccgtgctgtcagaggagctgtggggggtgggtgaggatgggagtccttctccagcaaatgctggagatgcacccaccttcccacgaccccctggacctcgcaacaccctgtggcaggagcttccggctgtgcaagccagcggtcttctggataccctcagcccccaggagaggcgcatgcaggagagtcttttcgaggtggtgacgtccgaggcttcctacctgcgctccctgcggctgctgaccgacaccttcgtgctgagccaggcactccgggacacgctcaccccccgtgatcaccacacactcttctccaatgtgcagcgagtccagggagtcagcgagcggtttctagcaacgctcctgtcccgtgtgcgctcttccccccacatcagcgacttgtgtgatgtggtgcatgcccacgctgtggggcctttctcggtgtatgtggattatgtgcggaaccagcagtatcaggaggagacctacagccgcctcatggacaccaacgtgcgcttctccgccgagctgcgccggctgcagagcctccctaagtgtgagcggctcccgctgccgtccttcctgctactgcccttccagcgcatcacccggctgcgcatgctgctgcagaatatcctgcgccagacagaagaggggtccagccgtcaggagaatgcccagaaggccctgggtgctgtcagcaagatcatcgagcgttgcagcgctgaggtggggcgcatgaagcagactgaagagctgatccggctcacccaaaggctgcgcttccacaaagtcaaggccctgcccctggtctcctggtcacggcgcctggaattccagggagagctgactgagttagggtgccggagggggggcgtgctctttgcctcgcgcccccgcttcacccctctttgcctgctgctctttagcgacctgctgctcatcactcagcctaagagtgggcagcggttacaggttctggactatgcccatcgctccctggtccaggcccagcaggttccggatccatctggaccccctaccttccgcctctcccttctcagcaaccaccagggccgccccacccaccgactactccaagcttcttccctatcagacatgcagcgctggctgggagccttcccaaccccaggcccccttccctgctccccagacaccatctatgaggactgtgactgttcccaggaactgtgttcagagtcgtctgcacctgccaagactgaaggacggagtctggagtccagggctgcccccaaacacctgcacaagacccctgaaggttggctgaaggggcttcctggggccttccctgcccagctggtgtgtgaagtcacaggggaacacgaaaggaggaggcaccttcgccagaaccagaggcttctcgaggctgttggatcttcttcaggcacccccaatgcccccccaccctaatgcaggctgaggagggggcacatgttgggagacacctaccagtgtggcacggagagaacaaagcccattcatccattggattcactgtcagtggagatactacctctcgtggcaaccatagagatcgagcttcaggacagagcagccaatgaaaacggccgcctgaacccacagcaataagaatgaatgaggatgccttgaatgtgtggccaatggagacagaggcttagtgcagagcagccaatgggtactgagctggctgagcctatggccaatgagtattcctgctatgctcagggccaaggaagacaaatctaggtcatggcagttgaaaaagggcctcattggagataaagtcgtaggataaaattgggaacaggaatgagcaggaagccaatcagccaaagaaaatggtgatctggacccaagagaccagtagtcaccctgcttgtttctgcagcaatgactggtcctgtcttttgagtctgggaaatactagtttccattcctggatgcttcctgtgccctctcaagccagttcttctcttccagaagaattcagagtatgtgtctcagaaaatctgtgtgtgtacatgtgcatgtgtagatatgtgtgtatatgtatcaggaaaggcattctgctgactgtggtgtgtgtgtggtgattgtgctcctgacccacaaatgactgagtgctccatttcttcctttaccccccatttttcctattattcgctccaagaaagatgctaagtctgagctccagaagagactgtgctgggtgtggcttggcacccaggggatgagagccctgagctttgggtctcttggaggctagggttctgtggcagttgcagggcaatgttatggagcagccaacggcctggcagaggagcccaagggactgaagatggccagtagctgggtcctgaggcccctgaagtctgcagacccttctccttgccccaaacactggcctccataattcctgcctgcagatctcccaacttgaactataatccaccagccagcctcagccttgagctttggaaccacattagatcctgcatctgggtgaagaaacgggagctgtggaccacaggccagccagtgaacctcctgggctttcttgcctttgtcctgatcctctcacagaaacactgggccaaacagtggggagagattggagagcgggtgtggctgcccaaccccatccagagcatctgcttccagatgagccagtgcctcgcatgataccagaggaggcgagggacagagacagcaaggcagacagtggctggcaggggggcccaggcccgggacgaggcctccccttcagctcaggcacagcaacttgcccaggactgacactgtcaccctgactgcaggaggcacagggactccgggagactcagagggcgaagagcactggcatttggcatgtccatgacattggagactcccctagcagggtgcctgacgtgtggggaaccctcagtaaatagtggtgcatttgtattg

SEQ ID NO: 175921 - DNA, 537 bp, Homo sapiens
  Payload ID: 14538
  Gene Symbol: ARHGEF15
  Gene Name: Rho guanine nucleotide exchange factor (GEF) 15
  ENST ID: ENST00000583529
  CDS Start-End: 189-537
agaatcacaggaacacacacttggaaacctcagccctgcattcctcgctccaaggggcagacaggacaggctgaaaatagcaactggttccaaaaagataaagccctgggaggtgactgagagtggaggggattcaagggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctc

SEQ ID NO: 175922 - DNA, 668 bp, Homo sapiens
  Payload ID: 14538
  Gene Symbol: ARHGEF15
  Gene Name: Rho guanine nucleotide exchange factor (GEF) 15
  ENST ID: ENST00000581809
  CDS Start-End: 1-276
gcctccccgctgcggacctctcgctcccgcccccaccctccaagcatcggtcaccctgccgttgtcctcacatcctaccgctccactgctgagcgcaaactcctgccactcctcaagcctcccaaaccaactcgtgtcaggcaggatgccaccattttcggggaccccccacagccagatcttgatctgctttctgaagatggaatccaaacaggggacagtcctgatgaagctcctcagaatactcctccagcaactgtggaggggaggtactgaacacccccacccctactccctggttctctccccaccatgcttctacctgagggcagactaaccttcagctccagctaaatcccacctccacaaagaaggccgggcacggtggcttacatctgtaatcccagcactctgggaggccgcggcagaaggatcacctgaagtcaggagttcaagatcagcctggctaacgtggtgaaaccctgtctctactaaaaatacaaaaattagccgggcatggtgacgggtgcctgtaatcccagctactcgggaggctgaggcaggagaatggcttggacccagggagatggaggttgcagggagccaagagcgtgccactgcactccagcctggtcgacaagagagaaactccatctcaaaaaaaaaaa

SEQ ID NO: 175923 - DNA, 714 bp, Homo sapiens
  Payload ID: 14538
  Gene Symbol: ARHGEF15
  Gene Name: Rho guanine nucleotide exchange factor (GEF) 15
  ENST ID: ENST00000579439
  CDS Start-End: 92-714
actcagccctgggaggtgactgagagtggaggggattcaagggggatgactccagcagagcacctcactcctttgaagagcacagaggaagatgtcagcccagtcccttcctgcagcaacaccccccacgcagaagccccctcggatcatccgcccccgccctccttctcgttccagggctgcccagtccccagggcctccccacaatggctcctctccacaagaactaccccgaaactccaatgatgcaccaaccccaatgtgcacccccatcttctgggagcccccagctgcatccctcaagccccctgctcttttgcccccctcagcttctagagccagcctcgactcccagacttccccagactcaccttccagcacccccacacctagtccagtgtcccggcgctccgcctccccagaacctgctccccggtctccagtccccccacccaagccgtctgggtcaccctgcacgcctctgctccccatggctggagtcctggctcagaatggctctgcctcagctcctggcactgtgcggaggctggctggcaggtttgaagggggtgctgaaggccgggctcaggatgcagatgccccggagccaggtctccaagcgagagcagatgtgaatggggagagagaagctcccctcaccgggagtgggtcccaggagaacggtgctccagatgctggcctggcctgccctcc

SEQ ID NO: 175924 - DNA, 2219 bp, Homo sapiens
  Payload ID: 14539
  Gene Symbol: ARHGEF16
  Gene Name: Rho guanine nucleotide exchange factor (GEF) 16
  Uniprot ID: Q5VV41
  ENST ID: ENST00000378371
  CDS Start-End: 428-1693
cccatttcaggtgggacttgtggcataggagaggtcttgggactggtgcccagcctggggcagtcccctcccaaagcctccctctcccacacagccgtgagagcctgtgggcctagaggactcagctggcgggttgcagggaggcgcagccttttgcaatcccccagggccacaggttaccctccttctctctctagacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccagaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctctgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtggagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtctccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctcagctgctgggccccacctccccactgcacccagggggcaactccacctggactgatgggcacaggaggcaccaatagcgattattgggggcaatgcgaggtctcctcctatgcccttcctacccctgagtgggacaagaagggccctgagtgcccaggagtgccccacgttctgagaaggggccggccggagggaggggacccggcagggagatttcggttttgaggtttctaaatacattaaagttatttcttaagaa

SEQ ID NO: 175925 - DNA, 2211 bp, Homo sapiens
  Payload ID: 14539
  Gene Symbol: ARHGEF16
  Gene Name: Rho guanine nucleotide exchange factor (GEF) 16
  Uniprot ID: Q5VV41
  ENST ID: ENST00000378373
  CDS Start-End: 420-1685
cgtgaggccctgtggagctgacatctattgggcacagcttcgcatgtggagccgagaggtctctggggtcccagggcagaatcgccgtgggcaacacctgccccggctgacagctgcggtttctgtgtctctcttttgtgcagaagacgctggggaggaaacgtgggcacaagggttccttcaaggacgacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccagaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctctgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtggagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtctccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctcagctgctgggccccacctccccactgcacccagggggcaactccacctggactgatgggcacaggaggcaccaatagcgattattgggggcaatgcgaggtctcctcctatgcccttcctacccctgagtgggacaagaagggccctgagtgcccaggagtgccccacgttctgagaaggggccggccggagggaggggacccggcagggagatttcggttttgaggtttctaaatacattaaagttatttcttaagaa

SEQ ID NO: 175926 - DNA, 3061 bp, Homo sapiens
  Payload ID: 14539
  Gene Symbol: ARHGEF16
  Gene Name: Rho guanine nucleotide exchange factor (GEF) 16
  Uniprot ID: Q5VV41
  ENST ID: ENST00000378378
  CDS Start-End: 406-2535
gaaggcgcaggcaccgggcggcggcggctcggcgggaatcgagaggcgcgatccagtccgggcgatcacgtgggctccagccggcccaggtggggctgtgacctgtgacgcaggcggcgccgccacaggtgcccgggacgcgccccgccccctccccggccctccccgcccgggccctcggacccggagcagccccgcccgcccagcgcccacctgcggggccgcagccgccgccctccagccagaccgcgcaggaagcggaggaggcgccccgggccggaccgcgctgccgcaggagcgaagcggctgcaggacaggacaggacccggcgctggaagctgcaccgccagcgcgccgcccctccgtccctccgccccgcggcgcaggaccccacagccgcccagcatggcccagcggcactcagacagctccttggaggagaagctcctgggacaccgcttccactcggagctccggctcgatgccggggggaacccagcctccgggctcccaatggtccgtggctccccgcgtgttagagacgatgccgccttccagccccaggtcccggcacccccacagcctcggcccccggggcacgaggagccatggcccatcgtcctgagcacagagagcccggcggccctcaagctgggcacccaacagctgatccctaagagcctggctgtggccagcaaggcaaagaccccagcccgccaccagagcttcggggcggctgtacttagcagggaggccgcccggcgggaccctaagctcctcccagcccccagcttctccctggatgacatggacgtggacaaggaccccgggggcatgctgaggcggaacctgcggaaccaatcctaccgggcggccatgaagggcctggggaagccaggtggccagggagatgccatccagctaagccctaagctccaggctctggctgaggaacccagccagcctcatactcggagcccggccaaaaacaagaagacgctggggaggaaacgtgggcacaagggttccttcaaggacgacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccagaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctctgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtggagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtctccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctcagctgctgggccccacctccccactgcacccagggggcaactccacctggactgatgggcacaggaggcaccaatagcgattattgggggcaatgcgaggtctcctcctatgcccttcctacccctgagtgggacaagaagggccctgagtgcccaggagtgccccacgttctgagaaggggccggccggagggaggggacccggcagggagatttcggttttgaggtttctaaatacattaaagttatttcttaagaa

SEQ ID NO: 175927 - DNA, 576 bp, Homo sapiens
  Payload ID: 14539
  Gene Symbol: ARHGEF16
  Gene Name: Rho guanine nucleotide exchange factor (GEF) 16
  ENST ID: ENST00000418137
  CDS Start-End: 35-576
gtgtcctccggtcccctctgcctcaggcagctgcatgtttgcctctgacctcctcagggctttagattgctgccctggggcgggaagctccggcctcctcccccagctgggcccccgacagctcctggcattcacagtgaactgtctggggaatcatcgctatttggggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagca

SEQ ID NO: 175928 - DNA, 836 bp, Homo sapiens
  Payload ID: 14539
  Gene Symbol: ARHGEF16
  Gene Name: Rho guanine nucleotide exchange factor (GEF) 16
  ENST ID: ENST00000445297
  CDS Start-End: 397-836
ctccgcacctctccatctgccgggaagatctgtgggacaagatccccccccgccctctggcctctccctctggatgccccatgctctttctgggctgctttggggctctggcggctggggggagcggggggctgacccaaggcgggttacacagagaggaaggtgacggggataggccctcggcaggacaggcctactccaggatcggacctacctgagccctgtggggtggctgtccatgttggccctggtccatcaggaggaggaaagaagggagactttggcccaggcttctaggacgtgtgaccgagagctcctgggcctgtgtccccccaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatgga

SEQ ID NO: 175929 - DNA, 7853 bp, Homo sapiens
  Payload ID: 14540
  Gene Symbol: ARHGEF17
  Gene Name: Rho guanine nucleotide exchange factor (GEF) 17
  Uniprot ID: Q96PE2
  ENST ID: ENST00000263674
  CDS Start-End: 351-6542
gagcgagcagccaagggcgttgggcaggcggacgcagagtcgaggaaccaagcgctgggatcccgcccaggcggtgccgcggtgcccctggtcgctccagccgcggcgggggctgggcctgggggtcggcgctgaggcgggaggggccgcccgggatggagacgttgcggccggtggccacagaaacttgagccgcggcagagaaacctctgctccggtctctgcgtcctcttcccacactcccgtgcgctgctttcggcgtgggccgctgcgctcctagggagtgggggcgcagggggggttggccgcggctgcccgaggccagcccccccggagtgagttacgccactatggcggacggggcaccccggccccagctttaccgcagcgtctcgttcaagctgctggagcgctggagcggcggccccgggctgagggaggaggacacggacacccccggcttgaggcgacgcgcctcgtgccggccgaccacggctgcccggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccaggaggcccagcgccgactctgaatccccaggaacgcccagccccgacggtgccgcgtgggagcctccggctcgggagtcgcggcagccaccgacgccaccccctcggacatgcttccccctggcgggtctgcgttcggcgcggcccctgaccgggccggagaccgaagggaggctgcgccggccgcagcagcaacaggagcgggcgcagcgtccagcggatggtttacattcttggcatatcttctcccaaccgcaggccggggcccgggcctcctgctcctcctcctccatcgccgcctcctatcctgtcagccgcagtcgtgctgccagctccagcgaggaggaagaggagggcccgccgcagctgcctggagcccagagtccggcctaccacggcggccactcctcgggcagtgacgacgaccgagacggtgagggcggccaccgctggggagggaggcccgggctcaggcctggaagctccctattggatcaggactgcaggcctgacagtgatgggttaaatctaagcagcatgaactcagcaggggtttctgggagccctgagcccccaacatctccaagagcccctagagaagaaggactccgggagtggggtagtggctctccgccctgcgtcccaggtccccaggagggacttcggcctatgtctgactctgtgggaggagctttccgtgtggccaaggtgagctttccctcgtacctggccagccccgcaggctcccgcggtagcagccgttattccagcacggagaccctcaaggacgacgacctatggtctagtaggggttctgggggctggggcgtgtaccgctcccctagctttggagctggggaagggctcctgcggtcccaggctcgaacccgtgccaaaggacctggaggcacctctagggcattgagggatggaggatttgagcctgaaaagagtcgacagcggaagtccctgtcaaatccagatatcgcctcagagaccctgacgcttctcagtttcctgcgctcagacctttcagagctgagggtccgaaaacctggtgggagctccggggaccgtggaagcaaccccctagatggcagagactcaccatccgcaggtggccctgtggggcaacttgaacccatacccatcccagccccagcatcacctggcacgcgccccacactcaaggacttgacagccactctgcggagagcaaagtcattcacctgctctgagaagcccatggcccgccgcctgccccgcaccagtgctctgaagtccagctcctccgagctcctgctcacaggccctggtgccgaggaggatccgctgcccctcatcgtccaggaccaatatgtgcaggaggcccgccaggtttttgagaagatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaattgagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggacatgcggaagcacgtggccatgaccctgctggacacagagcagtcgtatgtggagtcgctgcgcaccctgatgcagggctacatgcagccgctgaagcagccagagaactccgtgctctgtgacccttcactggtggacgagatcttcgaccagatccccgagctcctggagcaccacgagcaattcctggagcaggttcggcactgcatgcagacctggcatgcccagcagaaggtgggagccctgctcgtccagtcgttctccaaggatgtcctagtaaacatctattctgcctatatcgataacttcctcaatgcaaaggatgctgtgcgtgtggccaaggaggcgaggcctgcctttctcaagttcctagagcaaagcatgcgtgagaacaaggagaagcaggcgctgtctgacctcatgatcaagcctgtgcagcggatcccacgctacgagcttctggtgaaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggagcacatgttttacgtgggtcaggattcaagccgctgcgtggcttgcatggtggactccagcctgggtgtgtgggtgacattgaaaggtagtgcccacgtgtgtctctaccatccagacacctttgagcagctggcagaagtagacgtcactcctcccgtgcacaggatgctggcaggctcggatgccatcatccggcagcacaaggctgcctgtctgcgaatcacagcgctgctggtgtgtgaggagctgctgtgggtgggcaccagtgctggtgtcgtcctcaccatgcccacttcgcccggtactgtcagctgcccacgggcaccactcagtcccacaggcctcggccagggacacaccggccacgtccgcttcttggctgcagtccagctgccagatggcttcaacctgctctgcccaaccccaccacctcccccagacacaggccccgagaagctgccatcactggagcaccgggactccccttggcaccgaggccccgcccctgccaggcctaaaatgctggttatcagtggaggtgatggctatgaggacttccgactcagcagtgggggcggcagcagcagtgagactgtgggtcgagacgacagcacaaaccacctcctcctgtggagggtgtgaccctgtctgccgtggcccaggactcgcccgcccacctgccttcagcctgcttgcctctccctagcccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcttccagtcatgatcgggtgggggacatgtgggctgaccaggacctctgaccctggagcttctaccaaagacacagctgggtctggaccccacggggctggggagggccatgtgcaatatttggagggttttctggagggcagcaggaaggctggggaattccccatgtacagtatttatgtttctttttagatgtgtaccttcccaagcacttatttatgcagtgacctggtcacctggggtgggggtgatttgaggaaatgacatgaggaaaagaaacctattcctgccctggggaccaccctgggactctaaccaagccttcctggagggacccatgcgcccctgagccccattccattcatacagacacacacgtacgcacactgcatgtccaaggccctaaacattgcccgttgacataaactttccagggccccagcctgatggggctgccctcagtcctctagatcaagatgctgactattagggggcagtgattgccatctggggacctgtcaggctttgtcatttcccagtttgttggtggtgcctttagtggttccctaatttgggaacactgatggggccttggacagggctttctctcaggtaggagaaatgggcccatgatctcctcacagtcgcccccagtccttggccctgcttccctgtgtctcatgcactggcacatatggtcaccttggagggcagacctaggagcccctctgaccactgaatccgtctccacaccccttctgccaagggaagccccttcaggaaggaccccccaaagctgaggggctgaatgtagccttttcaacagagaaggctcccacttgagagcagcctctacctgaccccctggaccacagagagccactctgaccctcagccccctcgcttcttcagctaaaactccaaaggtttggtttcagatggggtttgttttgttctgtttggttttggttttgtttggggtgggtgggtcattgcggtcttagattatgtttctcttgctaccaaacagtcatgtattaactctctttggatgatgaagtttaaagagtcaataaatagaaacaccagatgactgca

SEQ ID NO: 175930 - DNA, 579 bp, Homo sapiens
  Payload ID: 14540
  Gene Symbol: ARHGEF17
  Gene Name: Rho guanine nucleotide exchange factor (GEF) 17
  ENST ID: ENST00000544519
  CDS Start-End: 1-579
cttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggacatgcggaagcacgtggccatgaccctgctggacacagagcagtcgtatgtggagtcgctgcgcaccctgatgcaggtggggctcggggcccactcccctgagaatggcctttctgagcctaggaggctgtcagatgggtgtgagcaaacccctttcatggacaagggactgaggccagagagccgtgtccctggcatccgtcgcctttccatgaagaacccccagcatggccattccagagaaggaggaaggcttctcccgggcaagagagaatgcagaggggccaggccaccccagggcaggcgtccct

SEQ ID NO: 175931 - DNA, 3029 bp, Homo sapiens
  Payload ID: 14541
  Gene Symbol: ARHGEF19
  Gene Name: Rho guanine nucleotide exchange factor (GEF) 19
  Uniprot ID: Q8IW93
  ENST ID: ENST00000270747
  CDS Start-End: 138-2546
ctgacatgctgacatcgccccctgaggacttggctgcaaccccagagcccccagggtgtcccggagccctggaccgtgctggcagctggacggagctccctggctgagggccaggtgggtggcagagcaaaagaggaatggactgtgggccacctgctaccctccagccccacctgactgggccacctggcactgcccaccaccctgtagcagtgtgccagcaggagagtctgtcctttgcagagctgcccgccctgaagcccccgagcccagtgtgtctggaccttttccctgttgccccagaggagcttcgggctcctggcagccgctggtccctggggacccctgcccctctccaagggttgctatggccattatccccaggaggctcagatacagagatcaccagcggggggatgcggcccagcagggctggcagctggccacactgtcctggtgcccagcccccagctctggagggaccctggagtccccgacacacacagccacagcgccgggccagccacggctcggagaagaagtctgcctggcgcaagatgcgggtgtaccagcgtgaagaggtccccggctgccccgaggcccacgctgtcttcctagagcctggccaggtagtgcaagagcaggccctgagcacagaggagcccagggtggagttgtctgggtccacccgagtgagcctcgaaggtcctgagcggaggcgcttctcggcatcggagctgatgacccggctgcactcttctctgcgcctggggcggaattcagcagcccgggcactcatctctgggtcaggcaccggagcagcccgggaagggaaagcatctggaatggaggctcgaagtgtagagatgagcggggaccgggtgtcgcggccagcccctggtgactcacgagagggcgattggtccgagcccaggctagacacacaggaagagccgcctttggggtccaggagcaccaacgagcggcgccagtctcgattcctccttaactccgtcctctatcaggaatacagcgacgtggccagcgcccgcgaactgcggcggcagcagcgcgaggaggagggcccgggggacgaggccgagggcgcagaggaggggccggggccgccgcgggccaacctctcccccagcagctccttccgggcgcagcgctcggcgcgaggctccaccttctcgctgtggcaggatatccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggagctagggaagtttgccgttttcgtccatgccaagatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgcctccgaaacctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcctgagtgggtgctggttgctgtgtcttgtctgtaaataaactcctatcatgccttt

SEQ ID NO: 175932 - DNA, 921 bp, Homo sapiens
  Payload ID: 14541
  Gene Symbol: ARHGEF19
  Gene Name: Rho guanine nucleotide exchange factor (GEF) 19
  ENST ID: ENST00000449495
  CDS Start-End: 1-921
ggcgggatcgaggacaggaaaggcttgcacaatttcccgcggcgggacgtgggtcgccgggcccgcccggcgccagattaggagtggggctagagaaggggcgaggacgcgaggtgtggcgtcctggggtctggggatgtgaggccagggcctccgaggtgaactggtcctgccctttcgaccccgtgtgtgccctccctcaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaagg

SEQ ID NO: 175933 - DNA, 582 bp, Homo sapiens
  Payload ID: 14541
  Gene Symbol: ARHGEF19
  Gene Name: Rho guanine nucleotide exchange factor (GEF) 19
  ENST ID: ENST00000441785
  CDS Start-End: 1-504
gaaaggcttgcacaatttcccgcggcgggacgtgggtcgccgggcccgcccggcgccagattaggagtggggctagagaaggggcgaggacgcgaggtgtggcgtcctggggtctggggatgtgaggccagggcctccgaggtgaactggtcctgccctttcgaccccgtgtgtgccctccctcaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctgtagggctgggggctctgaaaggggcgggggcgtggagggagtctcaggcaggtgtaggcactgagggctgggtgacgtaag

SEQ ID NO: 175934 - DNA, 2552 bp, Homo sapiens
  Payload ID: 14542
  Gene Symbol: ARHGEF25
  Gene Name: Rho guanine nucleotide exchange factor (GEF) 25
  Uniprot ID: Q86VW2
  ENST ID: ENST00000286494
  CDS Start-End: 461-2203
attcagctctccgctccgctgggacccgcacagcgccagtggctcgggggtcggccctcgcctcctccccggcccgggcctagagccacccctaaccagaggccggagacagctggagcggctgccgcatcccggcccagcctcccctaccatccctcccccttccactggacatctggaccctaggcccccgcaccgacagggttccggaaaccctccccgcccagcccggcggccgggccccgcgcctctctctctctagagcccccagccctcctcaagactagacttccgcctacccctggacacctcctcccggtcccctccctccccccctcccacagcctggaccggggtaggagggagggggggtgtgcgcccggcgccgtccccgccccgccccccgtgattccccctgcatggccggcccgggtggggggcgcgggggggcccgggcgccatgcggggggggcacaaagggggtcgctgtgcctgtccccgtgtgatccgaaaagtgctggcaaaatgcggctgctgcttcgcccgggggggacgtgaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcagcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatca

SEQ ID NO: 175935 - DNA, 2246 bp, Homo sapiens
  Payload ID: 14542
  Gene Symbol: ARHGEF25
  Gene Name: Rho guanine nucleotide exchange factor (GEF) 25
  Uniprot ID: Q86VW2
  ENST ID: ENST00000333972
  CDS Start-End: 38-1897
ctcgaccctgaaacttggagcagggtgggggttcagtatgaagcccccggaccgccccgcccctggccgcactgaccggatactgggggtcatggggggcatgctgcgcgcatgcgccctccctgggcaggaggggcccccaaggagaagccctctagggttggtgggtaccgagccagagtctgaacgtacggagggagatcacagaagggatcgcgaacatgaggtcctcgccggggctctgcagcccgaatcctattccattgcgggcagtgaggggagtatatcggcttctgctgcctccggtctggctgccccctctggccccagctctggcctcagctctggcccctgttccccaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcagcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatca

SEQ ID NO: 175936 - DNA, 2103 bp, Homo sapiens
  Payload ID: 14542
  Gene Symbol: ARHGEF25
  Gene Name: Rho guanine nucleotide exchange factor (GEF) 25
  Uniprot ID: Q86VW2
  ENST ID: ENST00000616622
  CDS Start-End: 331-1755
gggggtcgctgtgcctgtccccgtgtgatccgaaaagtgctggcaaaatgcggctgctgcttcgcccgggggggacgtggggtgccctggtgaaattttctatcctggccaactcaaatgaggatggcaagagagtgagcccttggagagagaggctgagcatcatgaagagaagaccctgggagttccctggggaccctgagtctggagctggggcaaggccccccagggcccgtcagtggcctgaggagatggttggatcattccaaacattgtctcagtgtggaaactgaggcagacagtggtcaggcaggaccatatgagaactggatgttggagccagctctagccacaggagaggagctgccggaactgaccttgctgaccacactgttggagggccctggagataagacgcagccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcattaaggtgagctgcctgggactggaggggaacctccaaggtgacccttgccgctttgcactgacctccagagggccagagggtgggatccagcgctatgtcctgcaggctgcagaccctgctatcagtcaggcctggatcaagcatgtggctcagatcttggagagccaacgggacttcctcaacgcattgcagtcacccattgagtaccagagacgggagagccagaccaacagcctggggcggccaagagggcctggagtggggagccctggaagaattcagcttggagatcaggcccagggcagcacacacacacccatcaatggctctctcccctctctgctgctgtcacccaaaggggaggtggccagagccctcttgccactggataaacaggcccttggtgacatcccccaggctccccatgactctcctccagtctctccaactccaaaaacccctccctgccaagccagacttgccaagctggatgaagatgagctgtaactggtgaaaaccatgggggtggtgctgactcagccgcctattccccaaggagcttcagggcagtccttctggcactgctccagaattcctccttcttggtgtgtctggagggtgggcaaggctgggagggatatcaacttggaggagaacacctagacccaaggacttttttctgcccaaggaacacagtttccttcagctcccatccctatgcatgcatcatggtccccccaaaaggaggatatgtgggtgggtgggagggctggggcaggggccagatagaaattattggttttgttttttaattttgtttttcctgttttctgagaataaaggttttgttatatc

SEQ ID NO: 175937 - DNA, 5254 bp, Homo sapiens
  Payload ID: 14543
  Gene Symbol: ARHGEF26
  Gene Name: Rho guanine nucleotide exchange factor (GEF) 26
  Uniprot ID: Q96DR7
  ENST ID: ENST00000356448
  CDS Start-End: 285-2900
agaactctgcgctactgcccacgcatctcacaaagtctactacgccgcgcgttctcggtttcaacgcacctccaggattcagggcttcctaagctgcaattcagcagggctcccttgcttgttctcactctgtgcccccggcaacgaccccgcgcgcctacactcccgtgccgcctcagctactagtccgcaacttctagccccaaaacgctggagctcagaacccagctcaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaaccttcccaaatgagctgataaaaaactgacgtgaggctgctttgccttcaataatacctagttttcagctgttccaactcgtttccaaatagaaattagctggaacacactacagtaatctcaaggaagggaaaattaggccttaaaagataccaagaagtcagcatggtacccaattgaaaccttttgaccttagtgggaattcattctatttgcactaaaagccttaacttgctgtattcagagtccctcttaactgtgagtttctatagaactttactttttccactagtgcacagagagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttaagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatacttgt

SEQ ID NO: 175938 - DNA, 2353 bp, Homo sapiens
  Payload ID: 14543
  Gene Symbol: ARHGEF26
  Gene Name: Rho guanine nucleotide exchange factor (GEF) 26
  Uniprot ID: Q96DR7
  ENST ID: ENST00000465817
  CDS Start-End: 132-1472
ggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttaagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatactt

SEQ ID NO: 175939 - DNA, 3929 bp, Homo sapiens
  Payload ID: 14543
  Gene Symbol: ARHGEF26
  Gene Name: Rho guanine nucleotide exchange factor (GEF) 26
  Uniprot ID: Q96DR7
  ENST ID: ENST00000465093
  CDS Start-End: 212-2827
aagtgtgggggcgtagtcaggcgtgggggcgggccggcgccggcgccgcggtcggcggcagcgctctcctaagctctcgcggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaa

SEQ ID NO: 175940 - DNA, 3781 bp, Homo sapiens
  Payload ID: 14543
  Gene Symbol: ARHGEF26
  Gene Name: Rho guanine nucleotide exchange factor (GEF) 26
  Uniprot ID: Q96DR7
  ENST ID: ENST00000496710
  CDS Start-End: 156-2531
ggcagcgctctcctaagctctcgcggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctgtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaatt

SEQ ID NO: 175941 - DNA, 3857 bp, Homo sapiens
  Payload ID: 14543
  Gene Symbol: ARHGEF26
  Gene Name: Rho guanine nucleotide exchange factor (GEF) 26
  Uniprot ID: Q96DR7
  ENST ID: ENST00000614308
  CDS Start-End: 167-2782
ccgcggtcggcggcagcgctctcctaagctctcgcggctgcgcttcggtcccggacccgggccacccacggggtagtgggtgctcctcggccccggacattgcaagccccagaaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaatt

SEQ ID NO: 175942 - DNA, 3975 bp, Homo sapiens
  Payload ID: 14543
  Gene Symbol: ARHGEF26
  Gene Name: Rho guanine nucleotide exchange factor (GEF) 26
  Uniprot ID: Q96DR7
  ENST ID: ENST00000618535
  CDS Start-End: 285-2900
agaactctgcgctactgcccacgcatctcacaaagtctactacgccgcgcgttctcggtttcaacgcacctccaggattcagggcttcctaagctgcaattcagcagggctcccttgcttgttctcactctgtgcccccggcaacgaccccgcgcgcctacactcccgtgccgcctcagctactagtccgcaacttctagccccaaaacgctggagctcagaacccagctcaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaatt

SEQ ID NO: 175943 - DNA, 2353 bp, Homo sapiens; identical to SEQ ID NO: 175938
  Payload ID: 14543
  Gene Symbol: ARHGEF26
  Gene Name: Rho guanine nucleotide exchange factor (GEF) 26
  Uniprot ID: Q96DR7
  ENST ID: ENST00000629129
  CDS Start-End: 132-1472

SEQ ID NO: 175944 - DNA, 3781 bp, Homo sapiens; identical to SEQ ID NO: 175940
  Payload ID: 14543
  Gene Symbol: ARHGEF26
  Gene Name: Rho guanine nucleotide exchange factor (GEF) 26
  Uniprot ID: Q96DR7
  ENST ID: ENST00000630729
  CDS Start-End: 156-2531

SEQ ID NO: 175945 - DNA, 5246 bp, Homo sapiens
  Payload ID: 14544
  Gene Symbol: ARHGEF28
  Gene Name: Rho guanine nucleotide exchange factor (GEF) 28
  Uniprot ID: Q8N1W1
  ENST ID: ENST00000296794
  CDS Start-End: 177-5132
aaaccttggcttcagcccggccgccgccaggcgttggcatcgccggggagagccttccggactccgggcggcggctggctgggggcgcgttccgaggcgccctcaggcagggcgcgggggcagagcctcgcctgggttctggaggctgcggggccatcgctccagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggtaattaacactttaaacatcatctgtatagtttgaacaagaagttgtccctctgaatggttggctcttgtgtagagtgaatcaaagtcctccctagcatgggaataaatcggtactgatga

SEQ ID NO: 175946 - DNA, 4424 bp, Homo sapiens
  Payload ID: 14544
  Gene Symbol: ARHGEF28
  Gene Name: Rho guanine nucleotide exchange factor (GEF) 28
  Uniprot ID: Q8N1W1
  ENST ID: ENST00000296799
  CDS Start-End: 72-4250
ctggctggggacgccccgagttcttcctgagtctctactgtttcatctgttgatttcaccaaaacaaaaagatggattctgactccgactcaccttttaactactcgtggccttcctttcccaaaatgaagattcgaagaaggacgtccaaacaagatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatgatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagcc

SEQ ID NO: 175947 - DNA, 5792 bp, Homo sapiens
  Payload ID: 14544
  Gene Symbol: ARHGEF28
  Gene Name: Rho guanine nucleotide exchange factor (GEF) 28
  Uniprot ID: Q8N1W1
  ENST ID: ENST00000437974
  CDS Start-End: 21-5216
tcattgcagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggctccagtatgacaaagtgcagttgtacgttgacatctcccccgggactgtggactggaaccacatctactttgaaagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccgga

SEQ ID NO: 175948 - DNA, 6118 bp, Homo sapiens
  Payload ID: 14544
  Gene Symbol: ARHGEF28
  Gene Name: Rho guanine nucleotide exchange factor (GEF) 28
  Uniprot ID: Q8N1W1
  ENST ID: ENST00000426542
  CDS Start-End: 21-5138
tcattgcagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatgatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatta

SEQ ID NO: 175949 - DNA, 2936 bp, Homo sapiens
  Payload ID: 14544
  Gene Symbol: ARHGEF28
  Gene Name: Rho guanine nucleotide exchange factor (GEF) 28
  ENST ID: ENST00000512883
  CDS Start-End: 1-1956
atgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggctccagtatgacaaagtgcagttgtacgttgacatctcccccgggactgtggactggaaccacatctactttgaaagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatta

SEQ ID NO: 175950 - DNA, 560 bp, Homo sapiens
  Payload ID: 14544
  Gene Symbol: ARHGEF28
  Gene Name: Rho guanine nucleotide exchange factor (GEF) 28
  ENST ID: ENST00000509848
  CDS Start-End: 311-560
atcgccggggagagccttccggactccgggcggcggctggctgggggcgcgttccgaggcgccctcaggcagggcgcgggggcagagcctcgcctgggttctggaggctgcggggccatcgctccaggcccacagcgtccccgcattggttggctgggtgggccgaggaacagtggcaacatctgtgtttgtgcggcttctcccgccttgacccctgcctgggtatccacacatctcctcacaccaggagttatagaggttcaccacggaccacaccaattgggcaaaatccaaagaaaatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgacca

SEQ ID NO: 175951 - DNA, 6273 bp, Homo sapiens
  Payload ID: 14544
  Gene Symbol: ARHGEF28
  Gene Name: Rho guanine nucleotide exchange factor (GEF) 28
  Uniprot ID: Q8N1W1
  ENST ID: ENST00000513042
  CDS Start-End: 177-5294
aaaccttggcttcagcccggccgccgccaggcgttggcatcgccggggagagccttccggactccgggcggcggctggctgggggcgcgttccgaggcgccctcaggcagggcgcgggggcagagcctcgcctgggttctggaggctgcggggccatcgctccagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatgatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatt

SEQ ID NO: 175952 - DNA, 6351 bp, Homo sapiens
  Payload ID: 14544
  Gene Symbol: ARHGEF28
  Gene Name: Rho guanine nucleotide exchange factor (GEF) 28
  Uniprot ID: Q8N1W1
  ENST ID: ENST00000545377
  CDS Start-End: 177-5372
aaaccttggcttcagcccggccgccgccaggcgttggcatcgccggggagagccttccggactccgggcggcggctggctgggggcgcgttccgaggcgccctcaggcagggcgcgggggcagagcctcgcctgggttctggaggctgcggggccatcgctccagatgcgaaagccatggagttgagctgcagcgaagcacctctttacgggcagatgatgatctatgcgaagtttgacaaaaatgtgtatcttcctgaagatgctgagttttactttacttatgacggatctcatcagcgacatgtcatgattgcagagcgcatcgaggataacgttctccagtccagcgtcccaggccatgggcttcaggagacggtgacggtatctgtgtgcctctgctcggaaggttactctccggtgaccatgggctctggctcagtgacctacgtggacaacatggcttgcaggctggctcgtctgctggtgacgcaggccaatcgcctcacagcctgcagccaccagaccctgctgaccccatttgccttgacggcaggagcactgcctgccttggatgaggagctcgtgctggctctgacccatctggaattgcctctagagtggactgtgttgggaagttcttcacttgaagtatcttctcacagagaatctcttctacacctggctatgagatggggcctggctaaactttcccagttcttcttgtgtctcccggggggagtccaggccttggctttacccaacgaagagggtgccacaccattagacttagctttacgtgaaggacactccaagctggtggaagacgtcacaaattttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggcctttgagccagaagccaggccagaggaaagaacagctatgccctccagcggtgcagaaactgaagaagagattaagaattcagtgtccagcagatcagcagctgaaaaggaagatataaagcgtgtcaaaagcctggtggttcaacacaatgaacatgaagaccagcacagcctagatttggatcgctccttcgatatcctaaaaaaatccaagccgccctcgacattgcttgctgcaggccggctttcagacatgctgaatggaggtgatgaagtctacgctaactgtatggtgattgatcaggttggtgatttggatatcagctatattaatatagagggaatcactgccactaccagccctgaatccagaggttgcactctgtggcctcagagcagcaaacacacccttcctacagaaaccagtcccagtgtgtacccacttagtgaaaatgtcgaagggacagcacacactgaagcccagcagtccttcatgtcaccatcaagttcgtgtgcttccaacttgaatctttcttttggttggcatggatttgaaaaggaacaaagtcatctaaagaaaagaagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggaatcactgctttctggagttcgctcacgttcttattcttgctcatcacccaaaatttctttaggaaaaactcgtttggtgcgtgaattaacagtatgcagttcaagtgaagagcaaagagcttacagcttatcggagccaccaagagaaaacagaattcaggaagaagaatgggataaatacatcatacctgccaaatcagagtctgaaaaatataaagtgagtcgaactttcagtttcctcatgaataggatgactagccctcggaataaatcaaagacaaaaagcaaggatgccaaagataaagagaagctgaatcgacatcagtttgccccaggaacattctctggggttctgcagtgtttggtttgtgataaaacactcctggggaaagagtcactgcagtgttctaactgtaatgcaaatgtgcacaaaggttgtaaagatgctgcgcctgcatgcaccaagaaattccaagagaaatataacaagaacaaaccacagaccatccttggaaattcttcatttagagacatcccacagcctggtctctccttgcacccttcttcctccgtgcctgttggattgccgactggaaggagggagactgtgggacaggtccatccattgtccagaagtgttccaggcaccaccttggaaagcttcaggaggtcagccacatccttggagtctgagagtgaccataacagctgcagaagcaggtctcattctgatgagctgctacagtccatgggctcttctccctctacagagtctttcataatggaagatgttgtggattcttctctgtggagtgacctcagcagtgatgcccaggagtttgaagcagaatcttggagtcttgtggtggatccctcattttgtaataggcaggagaaggatgtcatcaaaagacaggatgtcatttttgagctaatgcaaacagagatgcatcacatccagaccctgttcatcatgtctgagatcttcaggaaaggcatgaaagaggagctgcagctggaccacagcaccgtggataaaattttcccctgtttagatgagttgcttgaaatccacaggcatttcttctacagtatgaaggaacgaaggcaggaatcctgtgctggcagcgacaggaattttgtgatcgaccgaattggagatattttggtacaacagttttcagaagaaaatgcaagtaaaatgaagaaaatatatggagaattctgttgccatcataaagaagctgttaacctctttaaagaactccagcagaataaaaagtttcagaattttattaagctccgaaatagtaatcttttggctcgacgccgaggaattccagaatgcattctgttggtcactcagcgtattacaaaataccctgtcttggtggaaaggatattgcagtacacaaaggaaagaactgaggaacataaagacttacgcaaagcgctttgcttaattaaagacatgattgcaacagtggatttaaaagtcaatgaatatgagaaaaaccaaaaatggcttgagatcctaaataagattgaaaacaaaacatacacgaagctcaaaaatggacatgtgtttaggaagcaggcactgatgagtgaagaaaggactctgttatatgatggccttgtttactggaaaactgctacaggtcgtttcaaagatatcctagctctacttctaactgatgtgctgctctttttacaagaaaaagaccagaaatacatctttgcagccgttgatcagaagccatcagttatttcccttcaaaagcttattgctagagaagttgctaatgaggagagaggaatgtttctgatcagtgcttcatctgctggtcctgagatgtatgaaattcacaccaattccaaggaggaacgcaataactggatgagacggatccagcaggctgtagaaagttgtcctgaagaaaaagggggaaggacaagtgaatctgatgaagacaagaggaaagctgaagccagagtggccaaaattcagcaatgtcaagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaagctgagagcctacaagttgcagtgaaggcctcacagatgggcgccgtgagtcaatcatgtgaggacagttgtggagactctgtcttggcggacacactcagttctcatgatgtaccaggatcaccgactgcctcattagtcacaggagggagagaaggaagaggctgttcggatgtggatcccgggatccagggtgtggtaaccgacttggccgtctctgatgcaggggagaaggtggaatgtagaaattttccaggttcttcacaatcagagattatacaagccatacagaatttaacccgtctcttatacagccttcaggccgccttgaccattcaggacagccacattgagatccacaggctggttctccagcagcaggagggcctgtctctcggccactctatcctccgaggcggccccttgcaggaccagaagtctcgcgacgcggacaggcagcatgaggagctggccaatgtgcaccagcttcagcaccagctccagcaggagcagcggcgctggctgcgcaggtgtgagcagcagcagcgggcgcaggcgaccagggagagctggctgcaggagcgggagcgggagtgccagtcgcaggaggagctgctgctgcggagccggggcgagctggacctccagctccaggagtaccagcacagcctggagcggctgagggagggccagcgcctggtggagagggagcaggcgaggatgcgggcccagcagagcctgctgggccactggaagcacggccggcagaggagcctgcccgcggtgctccttccgggtggccccgaggtaatggaacttaatcgatctgagagtttatgtcatgaaaactcattcttcatcaatgaagctttagtacaaatgtcatttaacactttcaacaaactgaatccatcagttatccatcaggatgccacttaccctacaactcaatctcattctgacttggtgaggactagtgaacatcaagtagacctcaaggtggacccttctcagccttcgaatgtcagtcacaaactgtggacagccgctggttccggccatcagatacttcctttccatgaaagcagcaaggattcttgtaaaaatggctccagtatgacaaagtgcagttgtacgttgacatctcccccgggactgtggactggaaccacatctactttgaaagatttggacacctcccacactgagtccccaaccccccatgactcaaattcacaccgccctcaactgcaggcgtttataacagaagcaaagctaaatctaccgacaaggacaatgaccagacaagatggggaaactggagatggagccaaagaaaatattgtttacctctaattgtgttgtcatttttccaaacaaaacaaaacactggcacttttgggagaaactttttgtctccattccttatgtatgtgtgattgtctgtgtccaaattgctttaagaataatatttaatatttcctggaagctcatttttttggcatgagtctaattaaattattgaaagccaccctgtttgtataatctttaacttatcaaatctaatttcagatttctggaggagaaactaacttgaataagcaggactattttaaaagttgttttgacgctagagtaaaattccatgtcacattttctacccaatcatctggatttcaagattccttttaagatctcaatgaagcaatttggatttaaagagtggtattcacaaggggtgaactttcacagtcagggcagttgcctcagtgcccacataggcagaggaggatgtgggaaagggtttttctcagctagtttttgtgtgctcatttcttctgggagcattaaaagtggtgatctgttacagtcactattcaactgggcacgtgttgtgattggtcagtcactgagccagggatacagtccggacttgcttagtacctaagcctaatgctggtggggtttcaagacatggttcagcatcatcttttaacaaggcccagaggcccagagcccccatcaagtcattttgatgtaaatagtgaactttgttagagccctcacttctatcaatcagctgtcctgtccctgccagcacctggagcaccaactaccactccctggaaagaacccttccctgcagttttttaaggacaaaactgcccactcctcattaagtttgctgcctggatacacttttccacaaaggaaaactggcatatcctgccttccgagtagtatgggtctctgtgtgagaaaccaggagatattttcatcttgttcggaaatacttgtatgtattttggtgtcaataaatatcttgtacctcatt

SEQ ID NO: 175953 - DNA, 3602 bp, Homo sapiens
  Payload ID: 14545
  Gene Symbol: ARHGEF3
  Gene Name: Rho guanine nucleotide exchange factor (GEF) 3
  Uniprot ID: Q9NR81
  ENST ID: ENST00000296315
  CDS Start-End: 170-1750
cactcggctccggagcccagtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacccccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatc

SEQ ID NO: 175954 - DNA, 3639 bp, Homo sapiens
  Payload ID: 14545
  Gene Symbol: ARHGEF3
  Gene Name: Rho guanine nucleotide exchange factor (GEF) 3
  Uniprot ID: Q9NR81
  ENST ID: ENST00000338458
  CDS Start-End: 111-1787
agcccaggggagccgccgccgcagccgccgccgccgcggtgagttttccagcctggagaggccgaaccagcgcgggggtcgaggagacctgagcctgccatactgagtctatggacagttccacagcaatgaatcaatgcagctgtagaggaatggaagaaaacaaggaaaggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatc

SEQ ID NO: 175955 - DNA, 3992 bp, Homo sapiens
  Payload ID: 14545
  Gene Symbol: ARHGEF3
  Gene Name: Rho guanine nucleotide exchange factor (GEF) 3
  Uniprot ID: Q9NR81
  ENST ID: ENST00000413728
  CDS Start-End: 545-2143
gcagaagagctgtcagatctttcccttcagcacttaaatcattgtcacgcaatggctttcatcttgggagattcatcctctgcattttggaactgagccttcctagtgttctgagagttttctgctgtctgttcagcttagcacgctaagaagctggagaggtacccagcagcctggttgcattctccgtcttggaaaagtatttaactgctttgagaaatcatggaatcgtttctggccacattgtgagattgtattgaattttctttttaagtttttaaatttttatatgcaaatgctggaaagcttggagacagtctatttcaaagaaggctgttgatttctgagactggcaggggcataaaatgacatgagagtgtctcagcaggattccaaattcacgaaagatttttccaggcacctactatgttcagaacggggatgcagaaatatcctggagaatctgaagttctgccttaaccctcgaaactttgaaagcaatggctgaaaaggaaagatgaatacctagaggctccctctggaaatgattgaggtttgccaccacaattggctactttggctttgcccatcaaaatttggtatcttcatgtgctgtctagcatctactacaggtcagatggagcttaggaggacaagggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtc

SEQ ID NO: 175956 - DNA, 667 bp, Homo sapiens
  Payload ID: 14545
  Gene Symbol: ARHGEF3
  Gene Name: Rho guanine nucleotide exchange factor (GEF) 3
  ENST ID: ENST00000468727
  CDS Start-End: 115-667
agcccaggggagccgccgccgcagccgccgccgccgcggtgagttttccagcctggagaggccgaaccagcgcgggggtcgaggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagc

SEQ ID NO: 175957 - DNA, 2693 bp, Homo sapiens
  Payload ID: 14545
  Gene Symbol: ARHGEF3
  Gene Name: Rho guanine nucleotide exchange factor (GEF) 3
  ENST ID: ENST00000465659
  CDS Start-End: 1-709
agtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacccccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctg

SEQ ID NO: 175958 - DNA, 2024 bp, Homo sapiens
  Payload ID: 14545
  Gene Symbol: ARHGEF3
  Gene Name: Rho guanine nucleotide exchange factor (GEF) 3
  ENST ID: ENST00000495373
  CDS Start-End: 152-1402
agtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacccccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaagtatggatagcagtcggggttgacctgttgaatgtttttggccgtggtagtttggagggagtgggcagctggtggaaagagaaaagccacggtcttgaagtcaaactgcatttgtatgctatttcatcacttcctgattatgtactttgtttagtccctgtgattctcagtttctcatctccaaaatggaaatgcataggtacctccttcataagattgttataaggatttagtaagataatctaagtgaaactgtctgcacatagttagtgctccttaagttccctttctctgtctttttccattggataaaaacatgcttaataccagatagtccctacatggatgccagttgcgttatggtgggttttgcagctgaactggtaaacttgtccctaaagagacataagaatggtcaactggaatgtggattcatctgtaacattactcagtgggcctaatttaagacttaataaacaaattaactaaaagaagccaagatagcaatatctatcgagtatctaacatgatactcggtgaaacaagcaggtaacttccttcccctatggagcttgcattgtgatggaggagaaagatgataaacaaatgaatactccaggtgttgttaagaaaacttaaaacccg

SEQ ID NO: 175959 - DNA, 514 bp, Homo sapiens
  Payload ID: 14545
  Gene Symbol: ARHGEF3
  Gene Name: Rho guanine nucleotide exchange factor (GEF) 3
  ENST ID: ENST00000468466
  CDS Start-End: 215-514
ttttccagcctggagaggccgaaccagcgcgggggtcgaggtttattgtgtgcatccaccaaggagaatgtaggattcaagaggacagaggtgtgttgtcctgttgactactgactcctgctccatggcatacagcgggtgcacaataactgtcctgagtgaatgaacacccattgactgaagtgaggagacctgagcctgccatactgagtctatggacagttccacagcaatgaatcaatgcagctgtagaggaatggaagaaaacaaggaaaggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcag

SEQ ID NO: 175960 - DNA, 2197 bp, Homo sapiens
  Payload ID: 14545
  Gene Symbol: ARHGEF3
  Gene Name: Rho guanine nucleotide exchange factor (GEF) 3
  ENST ID: ENST00000497267
  CDS Start-End: 455-1948
aactgagccttcctagtgttctgagagttttctgctgtctgttcagcttagcacgctaagaagctggagaggtacccagcagcctggttgcattctccgtcttggaaaagtatttaactgctttgagaaatcatggaatcgtttctggccacattgtgagattgtattgaattttctttttaagtttttaaatttttatatgcaaatgctggaaagcttggagacagtctatttcaaagaaggctgttgatttctgagactggcaggggcataaaatgacatgagagtgtctcagcaggattccaaattcacgaaagatttttccaggcacctactatgttcagaacggggatgcagaaatatcctggagaatctgaagttctgccttaaccctcgaaactttgaaagcaatggctgaaaaggaaagatgaatacctagaggctccctctggaaatgattgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactc

SEQ ID NO: 175961 - DNA, 757 bp, Homo sapiens
  Payload ID: 14545
  Gene Symbol: ARHGEF3
  Gene Name: Rho guanine nucleotide exchange factor (GEF) 3
  ENST ID: ENST00000477833
  CDS Start-End: 132-284
tccccgcccccggccccgcccagcccaggggagccgccgccgcagccgccgccgccgcggtgagttttccagcctggagaggccgaaccagcgcgggggtcgaggagacctgagcctgccatactgagtctatggacagttccacagcaatgaatcaatgcagctgtagaggaatggaagaaaacaaggaaagggctgttggaggtgtttctggaaccagcgcaatcaatggcaggaacaactggtttttcaggctattgagaaagtctgatttatgtggctgaagtatggtgttattgacccccccaccttcgactcctaagattccagaacaaactgagaattcatgcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggag

SEQ ID NO: 175962 - DNA, 669 bp, Homo sapiens
  Payload ID: 14545
  Gene Symbol: ARHGEF3
  Gene Name: Rho guanine nucleotide exchange factor (GEF) 3
  ENST ID: ENST00000473779
  CDS Start-End: 81-669
aggagcccatctggtgagctgagagttagtgaggggcccaagagaatggggcttgctctgccctgtgctttagatggaccatgtttgatagaaatatttggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaag

SEQ ID NO: 175963 - DNA, 1994 bp, Homo sapiens
  Payload ID: 14545
  Gene Symbol: ARHGEF3
  Gene Name: Rho guanine nucleotide exchange factor (GEF) 3
  ENST ID: ENST00000496106
  CDS Start-End: 113-1711
atgcagcccaagtggcggggaggagttccttcagggaaactatgctcagccctgttcagagaatcctgtgcacagggctccactgcagttaggagccggtgagtccgggtggatgaggtcagagcgccccatggtgtggtgctgcctctttgtccgttcgcagcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggatttt

SEQ ID NO: 175964 - DNA, 428 bp, Homo sapiens
  Payload ID: 14545
  Gene Symbol: ARHGEF3
  Gene Name: Rho guanine nucleotide exchange factor (GEF) 3
  ENST ID: ENST00000486829
  CDS Start-End: 81-293
aggagcccatctggtgagctgagagttagtgaggggcccaagagaatggggcttgctctgccctgtgctttagatggaccatgtttgatagaaatatttgtcctgttatacttcatgtaaagagaaccaactcagtattggctctgcgcctggtacatagcctaaacggcagcggcaaaacaactttcccatgtttccctctcctaaagcctggaatttcagagggttcttccagggatcaccccagaagaaaacagctgatacttacatctttgctccaggatctgctttaggggaactccaaactaacagcagcgaaaacggaaacagagcacccaagatgaagatgctgttagcctttgcagtctcgacataagtgagcctagtaataaacgggtcaaacccctttcccgagtcacgtcgctagc

SEQ ID NO: 175965 - DNA, 4300 bp, Homo sapiens
  Payload ID: 14546
  Gene Symbol: ARHGEF33
  Gene Name: Rho guanine nucleotide exchange factor (GEF) 33
  Uniprot ID: A8MVX0
  ENST ID: ENST00000398800
  CDS Start-End: 86-2698
gtgcagggaagaggaggtggcctgagccaggacgatgaggatgcaatgttgaagaataagctggagaagagaagtaaccggcactatggaaaaaaccaaaacaaagcaaggagagaatgaacatatgccggtgaataatccttccacgcagatttaccagttgcaggccctagcctccgaactcaaaactggtttcacagaagcaatgcaagaactgtcaagaattcaacatggagaatatgctttggaagaaaaggttaagagctgcagatgttccatggaagaaaaagttactgagatgaagaattcattaaactatttcaaggaagagctgagcaatgccatgtcgatgatccaagccatcacttccaaacaagaagaaatgcaacagaaaatcgagcagcttcaacaggagaagcgaagagaatctcgaaaagttaaagccaagaaaactcaaaaagaagagcacagctcacaggccgggcctgcccaagcacaaggaagtccttttcgttctatcaatatccctgagcctgttcttccaagcgaagactttaccaaccttttgccttctcaggcctacgagaaagcccaagagtccagatctgttcatgtaggagacagtaatgtaaaaggaatgatgggtcctggagtgaacccaacaactccagaagcagaagaaaacctcaagtcttgcctctcggctgatatccagtccaagggccatctcccatctggcatgtggaggcagcctaaggatggtaaagaatggggtgaagaatacgtcacaaaagaccacccagataaactcaaggaggctggccagggtagacacagctccttggaaaacgttttatgtgaaacctccttagctgctaaaagacagactgtggccctggaactgcttgaatctgaaagaaaatatgtcattaacatctctctgatcttgaagataaaagccacattccaggggtcagatggaaagaggaattccaaagagagaagcctcttccctggctctttacggtacctcgtccagcagcacctggatctgcttcacgcactgcaggaaagggtcctgaagtggccacgccaaggcgttcttggagatttattccttaagttaacaaatgacgagaataatttcttggattattatgttgcctacctaagggacctgcctgagtgcatctcattggttcatgttgtagtcctgaaagagggtgatgaagagattaaatctgacatctacacgttgttttttcacatagtccagcgcatccctgaatatctgatacatctgcagaacgtcctgaagttcacagagcaggagcaccctgactattatctactactggtgtgtgtccagcgcctccgagtatttatctcacactacaccctgctgtttcaatgcaatgaagatttgcttattcagaaacggaaaaagctcaagaagtcatccatggcgaagctgtacaaagggctggcttcccagtgtgccaatgctgggcaagatgcttcccccactgcaggtcctgaggctgtccgtgacactgggatccactcagaagagttgctgcaaccctacccttctgctcccagttctggccctgccatcacacatctgatgcccccagtgaagaaaagccaacagcagcaaagcctgatggagagcatgcagcccgggaagcccagtgactgggagctggagggcaggaagcacgagcggcccgagagccttctggcaccgacgcagttctgcgcggccgagcaggacgtgaaggcgctggccgggcccctgcaggccatcccggagatggacttcgagtcctctccggcggagccgctgggcaacgtggagcgctccctgcgcgccccggccgagctcctgcccgatgcccgcggcttcgtgcccgcggcctacgaagagttcgagtacggcggcgagatcttcgcgctgcccgcgccctacgacgaggagccgttccaggctccggccctcttcgagaactgctcgcctgcctcctccgagtccagcctggacatctgcttcctgcggcccgtcagcttcgccatggaggccgagcggccggagcacccgctgcagccgctgcccaagagcgctacgtcgccggcgggcagcagcagcgcctacaaactggaggcggcggcgcaggcgcacggcaaggccaagccgctgagccgctctctcaaagagttcccgcgtgcgccgccagccgacggcgtggccccacgcctctacagcacgcgcagcagcagcggcggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagtaaggagggagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaagtccagtggatcagaatacagggaaaaaactaatgagaatccctcaatggatccttcacccaccaaacaagatttcttcagaaaccgacttgctcttgcaaatgaccttgaccaaggaacagctgtgtaaaacatacttaaagttgtattgtcaagtggtaagatgaggataaaaagcttgtatatatctgtgtaggaatatatatatatatctatatctatatatatatatatatcgatgtataaatccctgaggaaaactaatataaatacttacatatgaaactaaacatacaagacattgaagagatgaagattagtttctggttaagatctggctttttgaacctcaacactggggaaaagggaaatgaagacttttcacatcattacagaaaaacacaataaatttggaggaaaataaatgtttgtaagaatgaaaacttccaacttgaagtcattccccgagtataatactgagcatgttcatatttaacatggatttgaattttatgcttcctaggcatttaacttattaactcatccagtgttcttaaactaatatacactatgttaggggccagttctgtcttgcttcatgtcttccaaaaaccctaaggcaatatctaacatcccttaaggcaaaggattaattaacagaactgtattttatatgttgcatatctgagttatggagaatttgtgcttaaaccatgattcagaaggttcaaagcttaaaaacacattgatctccaaacttgttctgtggttatggaaatcagtaaagggaacaaggatttctgtagaaactggggagagaggaaggcaaagaaacattttcccttgtgtgggttgagctgaggatggaaacagtccagtctgtgttttattgagtactcagtattcaagacccactcgtgatcttgagtgtcacacacactcacaaccagatggactaggaaaaaagcagtgatttagccacatcttgttaaaaagactttctgcagcctgaaaagaaggtggcaatagcaccaaaacttcaatggctcacacacagcagttgctacaaacagcaggtcaaagtgaaaattcaggattgcagcacttgactgttttcctattttgtaaagaaaccaagctcttaaagcttagaggaatcagattgcaacgaggcctgcctggctctggggtgataaaatgtgctctgtttccacatggatatgtgcaagatggtcagcatccttgatatgccccaaacatcagatttataatagaaaaaaaattgggtttaaacaatttgtctttattcccaggcagttcggtatagtaaattaggggtatttggtttctgttcattcaaaatcttggtactcaaactggtgtcttcagaagctgttcctctattgaagcgtttgttgataaaataggcaaaggttcacatgtaagtgttgcaagttttcttctccttgtctgatgacaaattaggaactcacctactgcgttttgaatagtagttgtctggaacacataaaggatcactgccaagttttttgagtttccaggatctaagtttaagccaagatttttgtttcccagaagtttatgaattcatttgaaattagatttttctcttattatgtggccggcagtgcttgcaagcacaacgccaaatcgactggacgtggaaagtgaaatactacagaagtcacaatctattaaataaaatgttaac

SEQ ID NO: 175966 - DNA, 4484 bp, Homo sapiens
  Payload ID: 14546
  Gene Symbol: ARHGEF33
  Gene Name: Rho guanine nucleotide exchange factor (GEF) 33
  Uniprot ID: A8MVX0
  ENST ID: ENST00000409978
  CDS Start-End: 266-2878
aggggaagtcaagcctctctactgcttctttttataacctttaagttaattcagaacccagataagccttgatctgaggatgatataaccaccgcaggcaacatgggaacttctagagaaaacaagaagaagacttcaaaaaacatgctgtgatgtctcccagtggagacagggcacgaggtgcagggaagaggaggtggcctgagccaggacgatgaggatgcaatgttgaagaataagctggagaagagaagtaaccggcactatggaaaaaaccaaaacaaagcaaggagagaatgaacatatgccggtgaataatccttccacgcagatttaccagttgcaggccctagcctccgaactcaaaactggtttcacagaagcaatgcaagaactgtcaagaattcaacatggagaatatgctttggaagaaaaggttaagagctgcagatgttccatggaagaaaaagttactgagatgaagaattcattaaactatttcaaggaagagctgagcaatgccatgtcgatgatccaagccatcacttccaaacaagaagaaatgcaacagaaaatcgagcagcttcaacaggagaagcgaagagaatctcgaaaagttaaagccaagaaaactcaaaaagaagagcacagctcacaggccgggcctgcccaagcacaaggaagtccttttcgttctatcaatatccctgagcctgttcttccaagcgaagactttaccaaccttttgccttctcaggcctacgagaaagcccaagagtccagatctgttcatgtaggagacagtaatgtaaaaggaatgatgggtcctggagtgaacccaacaactccagaagcagaagaaaacctcaagtcttgcctctcggctgatatccagtccaagggccatctcccatctggcatgtggaggcagcctaaggatggtaaagaatggggtgaagaatacgtcacaaaagaccacccagataaactcaaggaggctggccagggtagacacagctccttggaaaacgttttatgtgaaacctccttagctgctaaaagacagactgtggccctggaactgcttgaatctgaaagaaaatatgtcattaacatctctctgatcttgaagataaaagccacattccaggggtcagatggaaagaggaattccaaagagagaagcctcttccctggctctttacggtacctcgtccagcagcacctggatctgcttcacgcactgcaggaaagggtcctgaagtggccacgccaaggcgttcttggagatttattccttaagttaacaaatgacgagaataatttcttggattattatgttgcctacctaagggacctgcctgagtgcatctcattggttcatgttgtagtcctgaaagagggtgatgaagagattaaatctgacatctacacgttgttttttcacatagtccagcgcatccctgaatatctgatacatctgcagaacgtcctgaagttcacagagcaggagcaccctgactattatctactactggtgtgtgtccagcgcctccgagtatttatctcacactacaccctgctgtttcaatgcaatgaagatttgcttattcagaaacggaaaaagctcaagaagtcatccatggcgaagctgtacaaagggctggcttcccagtgtgccaatgctgggcaagatgcttcccccactgcaggtcctgaggctgtccgtgacactgggatccactcagaagagttgctgcaaccctacccttctgctcccagttctggccctgccatcacacatctgatgcccccagtgaagaaaagccaacagcagcaaagcctgatggagagcatgcagcccgggaagcccagtgactgggagctggagggcaggaagcacgagcggcccgagagccttctggcaccgacgcagttctgcgcggccgagcaggacgtgaaggcgctggccgggcccctgcaggccatcccggagatggacttcgagtcctctccggcggagccgctgggcaacgtggagcgctccctgcgcgccccggccgagctcctgcccgatgcccgcggcttcgtgcccgcggcctacgaagagttcgagtacggcggcgagatcttcgcgctgcccgcgccctacgacgaggagccgttccaggctccggccctcttcgagaactgctcgcctgcctcctccgagtccagcctggacatctgcttcctgcggcccgtcagcttcgccatggaggccgagcggccggagcacccgctgcagccgctgcccaagagcgctacgtcgccggcgggcagcagcagcgcctacaaactggaggcggcggcgcaggcgcacggcaaggccaagccgctgagccgctctctcaaagagttcccgcgtgcgccgccagccgacggcgtggccccacgcctctacagcacgcgcagcagcagcggcggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagtaaggagggagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaagtccagtggatcagaatacagggaaaaaactaatgagaatccctcaatggatccttcacccaccaaacaagatttcttcagaaaccgacttgctcttgcaaatgaccttgaccaaggaacagctgtgtaaaacatacttaaagttgtattgtcaagtggtaagatgaggataaaaagcttgtatatatctgtgtaggaatatatatatatatctatatctatatatatatatatatcgatgtataaatccctgaggaaaactaatataaatacttacatatgaaactaaacatacaagacattgaagagatgaagattagtttctggttaagatctggctttttgaacctcaacactggggaaaagggaaatgaagacttttcacatcattacagaaaaacacaataaatttggaggaaaataaatgtttgtaagaatgaaaacttccaacttgaagtcattccccgagtataatactgagcatgttcatatttaacatggatttgaattttatgcttcctaggcatttaacttattaactcatccagtgttcttaaactaatatacactatgttaggggccagttctgtcttgcttcatgtcttccaaaaaccctaaggcaatatctaacatcccttaaggcaaaggattaattaacagaactgtattttatatgttgcatatctgagttatggagaatttgtgcttaaaccatgattcagaaggttcaaagcttaaaaacacattgatctccaaacttgttctgtggttatggaaatcagtaaagggaacaaggatttctgtagaaactggggagagaggaaggcaaagaaacattttcccttgtgtgggttgagctgaggatggaaacagtccagtctgtgttttattgagtactcagtattcaagacccactcgtgatcttgagtgtcacacacactcacaaccagatggactaggaaaaaagcagtgatttagccacatcttgttaaaaagactttctgcagcctgaaaagaaggtggcaatagcaccaaaacttcaatggctcacacacagcagttgctacaaacagcaggtcaaagtgaaaattcaggattgcagcacttgactgttttcctattttgtaaagaaaccaagctcttaaagcttagaggaatcagattgcaacgaggcctgcctggctctggggtgataaaatgtgctctgtttccacatggatatgtgcaagatggtcagcatccttgatatgccccaaacatcagatttataatagaaaaaaaattgggtttaaacaatttgtctttattcccaggcagttcggtatagtaaattaggggtatttggtttctgttcattcaaaatcttggtactcaaactggtgtcttcagaagctgttcctctattgaagcgtttgttgataaaataggcaaaggttcacatgtaagtgttgcaagttttcttctccttgtctgatgacaaattaggaactcacctactgcgttttgaatagtagttgtctggaacacataaaggatcactgccaagttttttgagtttccaggatctaagtttaagccaagatttttgtttcccagaagtttatgaattcatttgaaattagatttttctcttattatgtggccggcagtgcttgcaagcacaacgccaaatcgactggacgtggaaagtgaaatactacagaagtcacaatctattaaataaaatgttaacataa

SEQ ID NO: 175967 - DNA, 514 bp, Homo sapiens
  Payload ID: 14546
  Gene Symbol: ARHGEF33
  Gene Name: Rho guanine nucleotide exchange factor (GEF) 33
  ENST ID: ENST00000411874
  CDS Start-End: 1-328
cggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaaaaatgggaacgcaactggtgaagatttctgtggtccttggggctggtggtgacatcaaagctttcctattttcagattttaggtccagtggatcagaatacagggaaaaaactaatgagaatccctcaatggatccttcacccaccaaacaagatttcttcagaaaccgacttgctcttgcaaatgaccttgaccaaggaacagctgtgtaaaacatacttaaagttgtattgtcaag

SEQ ID NO: 175968 - DNA, 594 bp, Homo sapiens
  Payload ID: 14546
  Gene Symbol: ARHGEF33
  Gene Name: Rho guanine nucleotide exchange factor (GEF) 33
  ENST ID: ENST00000433605
  CDS Start-End: 1-327
ggccgcgcgcccatcaaggccgagcgcgccgcgcaggcgcacggcccggccgccgccgccgtcgccgcccgcggcgcatccaggaccttcttcccccaacagaggtcccaaagcgaaaaacagacctatttggaagagatgcatttagaagatactaccagattctgtcccaaagaagaaagagaaagtgaacaaacatctttcagcgatcaaaatcccaggcaagaccagaaggggggctttcgcagctccttccgcaagctctttaaaaagaaaaatgggaacgcaactggtgaagatttctgtggtccttggggctggtggtgacatcaaagctttcctattttcagggacttctgacatgagaaaactggagaaggtgcagagctggaatggattacccaagtggcttaagcaagataaaggaagaatgcaccctcgactggggactcaaatggactgatctgagttgttgactattgattggctttggtctcttttgtggtggttgagattatagtatctctgcaatctgattactgtacgaatttctgcattctaccaaatgtagcatatatgtgtggttggcttcaa

SEQ ID NO: 175969 - DNA, 2431 bp, Homo sapiens
  Payload ID: 14547
  Gene Symbol: ARHGEF35
  Gene Name: Rho guanine nucleotide exchange factor (GEF) 35
  Uniprot ID: A5YM69
  ENST ID: ENST00000378115
  CDS Start-End: 131-1585
caggggcgggccgcgggtggggcggccgggcctgcgctggggacggctctggggactgcggccggcgccgggacctggaggggacgctggggccgaagcagcatgtgacaccgaccaggattcagccctgatggaggctgaggaggcccagcatggagcctctcctcccatctctgccatagaggaattcagcattatccctgaggctcccatgaggagcagccaggtctctgccttggggcttgaagctcaagaagatgaggacccatcctataagtggagagaggaacacagactctcagcaactcagcagagtgagttaagggatgtgtgtgactatgcgattgagacgatgccctcttttcccaaggaaggttctgcagatgtggagcccaatcaggaaagccttgtggctgaggcctgtgacactccggaacactgggaggcagtaccccagagcctagcaggccgacaagcaaggactctagctcccccagagctctgggcctgccccattcagagtgagcatctagacatggccccattttccagtgacctgggaagcgaagaagaggaggtggaattttggccaggacttacttctttgacattgggatctggacaggcagaagaagaagaggaaacctcttcagataactctggtcagaccagatattattctccctgcgaagagcatcctgcagagaccaaccagaatgaaggcgctgaaagtgggactatcaggcagggggaagagctgccatctgaggagctgcaggaaagtcaagggctcttgcatccccaggaggtccaagttctggaggagcagggacagcaggaagcaggatttcggggggaaggaactctgagggaggatgtttgtgccgatgggctattaggggaggaacagatgatagagcaggttaatgatgaaaagggagaacagaagcaaaaacaggaacaggtacaagatgtgatgcttgggagacaaggagaaagaatggggctcactggggagccagagggtctgaatgacggtgagtgggagcaggaggatatggagaggaaggctcagggtcagggaggtccagaacagggagaagagaggaagagggagctgcaggtgccagaagagaacagggcggactctcaggacgaaaagagtcaaacctttttgggaaaatcagaggaagtaactggaaagcaagaagatcatggtataaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctcccttgctagagcccatcagatgctctcaccagcccatttctctactgggctcctttttgactgaggagtcacctgacaaggaaaaacttctatcagtactttgatatgtcacagtttcatgtttatccagttcaatgtatttttaaatttttccttgagacttctttgactgatagattattgtgaagtgtgtttttaaatttccaaatgtttagggattttcatatctttcttatgctgatttccaattggattccctacaatgatttctggttttcatctgctctggatgattactatctcttttaaatttgttgtggcgagttttagggcctaggacagctctatcttgccatgtgtttcgtcagcactcaaaaaaaatatgtgtattctgctgttactgtgtggaatattctgtaaatgccaaatagattcttttggttaatggcattttgagttgttttatattcttgttgattttcttttttttcctctttttaaaaacatgaaatgcttcacaaaattttgtgtaatctatattcaagaaccattttaatcttgttggcatcattctgattttagaaagtgctgccaaagccaacactccttgctgattttctgtctagttctatcaattattgaaaaaggcatgaggaaatttctaactataattgtggattcatctatatctcctttcagttttctttttttaaaaaaaatcaatgaaaatttattaaattaagcataaagttactttcacatttatctacaaccacagtgaatacagttcttggcatgaagacaccacaacctttagaatttaaagcctcctcacctgcaagattacatatataaaactcccactattgtttctctaagagtggattagttcaccaagttaaaagttatatgatctagaatataataaaatggaaatgatttactcataa

SEQ ID NO: 175970 - DNA, 4968 bp, Homo sapiens
  Payload ID: 14548
  Gene Symbol: ARHGEF37
  Gene Name: Rho guanine nucleotide exchange factor (GEF) 37
  Uniprot ID: A1IGU5
  ENST ID: ENST00000333677
  CDS Start-End: 164-2191
agccgcgcccgccagcgccctcggtgggcacagccacccggagcggcgcgggtgccgggagctgggcgacgcgcccctcctgccccggctgcgctgttgcccgggcggccgacctccgtgcgtgagcgccggcaggcaccttgcgcgcgcggaacctgctgacatggccaagcatggagccgacgagccatcctccaggtcagggagtccggacagggaaggtagggcctctgaggacagatcgctgcttcatcagaggctggctgtccgggagctcatcgacactgaggtctcctacttgcacatgctccagctctgtgcctctgacatcaggagccgcctccagcagttgccgcagggagatctggatgtcctgttctcaaacattgatgatatcatcaaagtgaacagcagattcctccatgatctgcaggagacagcctccaaggaagaggaacaagtgcagctagttggtaacatatttctggaattccaagaggagttggagcaagtctataaggtctactgtgccagctacgaccaggccttgctactggtggacacgtaccggaaggagccggagctgcagcggcacatccagggcatcgttgaggcggtggtgccgcaagctggatcttcaggcctcagtttcttgctggtaattcctctgcagaggatcaccaggtacccactgctgctgcagaaaatcctggagaacacagtccctgatgccagtgcctatcctgtccttcagagggctgtctctgccctccaggacgtgaacaccaatatcaatgagtacaagatgcgcaaggaagtggcctccaagtacaccaaggtagagcagctgaccctccgggagcggctggcccgcatcaacacacacaccctctccaagaagaccacccggctgagccagctgctgaagcaggaggcggggctgatccccaggacagaagacaaggaatttgatgatttagaagagaggttccagtgggtgtctctgtgtgtgactgagctgaagaacaacgtggctgcttacctggacaatctgcaggctttcctctacttcaggccgcacgaatacaatctggacatccccgaggggcctgcagtgcagtattgcaatttggcaagagaccttcaccttgaggccttcctgaaatttaagcaacggctagaaggcctggtgtggcagccactgtgcagcctggccaaagccctgcttggccctcagaacctgatcaagaagcgtctggacaagctactggactttgagcgggtggaagagaagctgctggaggtgggcagtgtgacctaccaggaggaggccgcccggcacacataccaggcactcaactcgctgctagtggctgagctcccacagtttaaccagctggtcatgcagtggctgggccagatcatgtgcacattcgtgaccctccagagggaccttgcaaagcaagtgctgcagagggcagagggaagcatggcccagctgccccaccaccacgtcccagagcctgccttcaggaagctggtggaggacgcactgggccggacgagtaaccagcttcgctcctttcaagagacctttgagaaagtgcagccacctcccaccacacaaccgctccttccagggtctgaacgccaggtgcaggctctcctgagcaggtatggccctgggaagctgtaccaggtgacaagcaacatcagtgggactgggactctggacctgactctgcctcggggccaaatcgtggccatccttcaaaacaaggacaccaaaggcaacagcggccgctggctggtggacaccgggggacatcgtgggtatgtgccggctgggaaactacagctgtaccatgtggtccccagtgcagaggagctcagaaggcaggcggggctgaacaaagacccccgatgtctaacaccggagcccagcccagctctagtgccctctattcccaccatgaaccaggtcatagccgcgtacccttttgtggccagaagcagccatgaagtgagcctgcaggcaggccagcctgtgaccatcctggaggcccaggacaagaaggggaaccctgagtggagcctggtggaagtgaatggacagaggggttatgtgccttctggcttcttggccagggctcggagcccagttctgtggggctggagtctgccctcttagggtaccctctttggagcctacattgccaaatgatgggggaggcttagaggctctgaccctggggggaaaagaagcaaaggaaaggtggaggtggaagggaagaccaggccagggtgggtgaagcacactcaggaggcagccagaagacatgggcgggcctcgcagagtgcttggtgtggtgggggcacaggaggctccagccaggactgctcattatgtctgcataaagaactcattccgacctggggtcacaatgcacttggacagcaggtcacagctgattggccaggactctccataggttatggccagtcttagctgtgcctgcatccgggcctgcctgtgggcgtgggtcacacgggataatgttacctgcgtgctgtgtggttgcaggaagcgggttctggaggagtccagaactgcctggtcagacagttcacttcctacacatggtatcaggagacatcataaccaatgagtcagcttttatttctctatgctggaagctgagtttatcttgggcagtgacccactgggagccctctcaagtggggaagccatggatttatcggtgtagcagagaggttcccaagactcttgactggtcctgggagtgggtgtgaccaagtcatagttctggaatgtgtgtaggcaaattcagaggctgttccagggaagaggggattttgatactgtgttaggtggggtgtgtgaggctgttggcagcaggtgaacagctactgctgtgttctcaggactagggaacaaaggggtatgcaaatcatagaggaaactctgggaaggcggtgataaggcctggtgggtggggaggttagggaatggcttgctttcctgtttctggttagaaggggagccagggggaacccccagtggtttcaggtggcccctgaggtcctggaggcagccgtggatgtgatgcaattggctgtgggaccttagatgtaggacacaacttcagtgttcccatccagaaagacctcactcacagggttgtgctgagaatgacgtggggctaagcatgcagagctccctgtaaactgtgaagtgtgatacaaatgtaaatgacagcagtgatctcggggtggcccccggcatgctgccctcccccacgcccatgcctgtggcagcaaaccttgttcatcagtatagctttctttcctgtaacccaggatctaccttggggggcttctcaatactgcattctatgtagccagcctctttaacttggtaagtgagccaccccattctagaacctggaaattggagcccctcaaaaacagttcctgttcaaggaggactgacctgctggggcaatgttgggtgcagtgcagtccctgcttggggtggtcatgtctaggctgttgctctgggcaaagataagttgcaagattcacagaaatgggaaaatgtgaccaagtgtgatcttaacaactgacaaagtttgtaaccaacccaagttagaatgtgtgtcaaacaggaggtagtttagatatgcttccaagaacatgtctgtgttataaccatagtgcctaagcagtgagctctggtttttgaagggcttttaagaaatatatacatgtctgtgtcagtctataacttgcctcctctgggcctgttaaagcatgaagactgcatgacacaagagaaatgcaagccctacggttcctttctcagcagcgaattcacttgagaggatgctcttgactcattctctctgctctttcctgctcagatttctgataaaaatagagagcataggggaacagataatgaaataggaaacccactcgtgggttccacagatacctaccgaaggcctactgtgtgctagaattgtagctcaggagttctcagtgtagctgctcactgaagttaccatggcaggtttcaactggcagaatccaggctccgtcccacccagagattctgatgaaattggtttagggtgtggctcgggcctcaggaattcagaaagcttcccaggtgcttccaatgtgcagccagggttagggacctctaccctagacacaaagtattggacagatagacctggtgccagagatggccatgagctgtaagctaggacgtgccccacctgagctctgcactagctagttcaaacaggcgctttaaaggcagtgtgaaaggggacagcctgttctgccaggtctcagaatgtatatttattaagtgccattaaaagggacctgaacaaaattggatgtcttgtaggcataagggaggaaaataaaatatacttggaaccaagtctatgtcatgaagggaaaataaaaatgtattcagtagcacgtgggttatggtttctcatagaccaggggataagattaaaagtcactgaagagtgggaaaatgcatgttgagaagatgagaatggcctgtattttctccaggggaatctgtgtaatgtgccttttccctctccaaatgcctagaaccatggcactgtgtcttatttatttaaccgttgggctgtctcatactaaacttgcaaagatatttgcctatgaactgaacaagacttccaggagttgaagtctggttcacaagggtaccccttgcctcctgtgatggagtgagaactcttaaacccctcaggccccaactcagttgtggagatgaggacaagattacaatatcaaaagaaagatgaatgaattcttggttaatatgacgaaccccagctcaatgagtaactgatgtgaactgctgggaataaaggacttcaaagatggaaa

SEQ ID NO: 175971 - DNA, 498 bp, Homo sapiens
  Payload ID: 14548
  Gene Symbol: ARHGEF37
  Gene Name: Rho guanine nucleotide exchange factor (GEF) 37
  ENST ID: ENST00000505810
  CDS Start-End: 189-498
gttgtagcagagcctagctaattacccttcataattagaattgtcctatctactacggagtgttatagaccctctttccacaggaggggaagaaagaaagaagccggaatccccctgccatcctatgtctttgcattattgcctcactaccacatatgatcttcagaagaaaacctgaacctgctgacatggccaagcatggagccgacgagccatcctccaggtcagggagtccggacagggaaggtagggcctctgaggacagatcgctgcttcatcagaggctggctgtccgggagctcatcgacactgaggtctcctacttgcacatgctccagctctgtgcctctgacatcaggagccgcctccagcagttgccgcagggagatctggatgtcctgttctcaaacattgatgatatcatcaaagtgaacagcagattcctccatgatctgcaggagacagcctccaaggaagaggaacaagtgcagctagttg

SEQ ID NO: 175972 - DNA, 1437 bp, Homo sapiens
  Payload ID: 14549
  Gene Symbol: ARHGEF38
  Gene Name: Rho guanine nucleotide exchange factor (GEF) 38
  Uniprot ID: Q9NXL2
  ENST ID: ENST00000265154
  CDS Start-End: 147-806
agtcacagccaggtaaccctggagtgaagcggtttagttagaagggagcagataaactcgtcactctagtagctttaaccctcaccctgaggcaccttagcaatcagccattgcctgcaagcctccaaagcttgtctttgcctaatatggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggaccgaatacaaccagaaattacaagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaagactgataggctggatgtggatagcttgtttagcaacattgagtccgtgcatcagatatcagccaagctgctgtcattgttggaagaggccacaacagacgtggaaccggccatgcaagtaattggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagtaaggccttttcaaatgatgattcccatctcctctcagttgcctagcagggaacattttaaatggatgtagatgaaaggtctcacataaatcctatgttttatgagacttgctgggagctctgctttgcattccctttataaaaagctgacatgccagaagccctgattgactttttttccccctgcgagaatgactaaaaataacatggaagaagatttagagctctgcagcgattgaaaaatgcaatatcaaaatataaaatgtggaagaaaagcctcttcttaaagctattgtaacttgcctggccccacgtagttcaaggattatgtgagataacacgtggccccatgaccactggagcacatgggttaatggagttaggggaatggcctacaactctgcatggccgtcttctttccccaaactcactgtggggagatgggtgaagacaagtcaggccttgttaaagttagtttcagaacaattactcatgccttcctttctcatccctaaaacattggtgggggagctacacaatgtactttttcttttctagaggaagtatctattcactgtgaaaatctgaaaaatataacaaagtatgtgtaagataaaaaccccttgctatttca

SEQ ID NO: 175973 - DNA, 5454 bp, Homo sapiens
  Payload ID: 14549
  Gene Symbol: ARHGEF38
  Gene Name: Rho guanine nucleotide exchange factor (GEF) 38
  Uniprot ID: Q9NXL2
  ENST ID: ENST00000420470
  CDS Start-End: 145-2478
tcacagccaggtaaccctggagtgaagcggtttagttagaagggagcagataaactcgtcactctagtagctttaaccctcaccctgaggcaccttagcaatcagccattgcctgcaagcctccaaagcttgtctttgcctaatatggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggaccgaatacaaccagaaattacaagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaagactgataggctggatgtggatagcttgtttagcaacattgagtccgtgcatcagatatcagccaagctgctgtcattgttggaagaggccacaacagacgtggaaccggccatgcaagtaattggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagaaaatatacatgcaagaaggcaaaccaaacttattggacatgggctctttgatgatcaaaccaattcaacgtgtgatgaaataccccctattactgtgcgaacttcggaattccacccctccctctcacccagattacagagcactggacgatgcctttgctgctgtgaaggacattaatgttaacatcaatgaacttaaaagaaggaaagatttagttctaaaatacaagaagaatgacgaggatgaatcacttaaagacaaattgtctaaactaaatattcattcaattagcaagaaatcaaaaagagtgacaaatcatctgaagattctgaccagaggagaatcacaggttaaagacaatacctttaacagagaagaaaagctgtttagagctttagaaaagactgtgaggctttgtgtgaagaacatttcactctgtcttcaacacatacaggatgccatgcccctggctctgcagagtgtgatggaccttcaggagatttcatacaacaaagacgatgagatggactattctgagaccctaagtaatgccttaaattcgtgtcatgactttgcatctcacttacagagactcatcctgacccccttgtcagccctgctgtccttattcccagggcctcacaagctcatccagaaacgctatgacaaactgctggattgcaacagctacctgcagcgatcaacgggagaggagtcagacttggccaaaaaggagtatgaggccctcaacgcccagcttgtggaggagctccaggcattcaaccaggctgctcggaagattctgttgaactgtctatgcagcttcattaccctccttagggacctgatgctcgtggcacagcaggcttactccacacttgtgccgatgccactgttggtttcaagcatttctgagattcagaatcaagtactagaagagatccaaaatttgaattgtgtgaaagaaaacagtgccacctttattgagaggaaactcagttttgaaaagaagaaacctgtgcagattctgccagaaatgccacatcaaactgacattcatcgctccaaacttctatccacatatagtgcagaggaactctatcaagctaagcgcaagtgcaatgctacacaagaatatgacatcaatcttctggaaggagacttggtggctgtgatagaacagaaagatccactggggagtacaagcaggtggcttgtggacacaggaaatgtgaaaggatatgtttattcctccttcctaaaaccctacaatccagcaaaaatgcagaaagtggatgctgagaacaggttctgtgacgatgattttgagaacatcagcctcttcgtgtcttcacggccagctagtgacagtgtcacaggcacctcagaaagcagcattggtgatagcagctcatctcttagtggcacatgtggaaagtttgaaacaaatggtactgatgttgacagttttcaagaagtagacgaacagattttctatgcagttcatgcttttcaagcacggagtgaccatgaactcagccttcaggaataccagagagttcatatactcaggttttgtgacctaagtggcaataaagagtggtggttagctgaagctcaagggcagaaaggatacgtgccagctaactaccttggaaagatgacttatgcttaagaaaataagccttcaacttttattttccagcaagttgttgattgactacctcataaaactgacattacaaaactttggaccagaaagcaagaaacctctgaactacagaaactgatactgtactgggttttcaggaatactgtacttcctaacaggattattgcatgaatgtattataaaggatacatgttgaaagaaatactaagccaacagaaatagcaaagcaaatgacccaagcttcaactatcaactatttaaaagtgaagatcttttgaaggagtaattatattcttttatcatcaagaaaggttggatccaaaggtttttcaatttacttttttttttactgtatgatgtattttgccttaaatgtttttgtttttcatattgctctcttgcaaatgcatacatgtttatatacatacatataaaccatatatattatgtagctttatacacgtatgtggataatatgaattatacacctatatgtataaatcagagtatacaccaaatatacataagaagaatataccaccaactagaagtctttgataatatattttgttaatgtttcgtttatatgttttgaactaaaactgaataacttgatattaacatgtaacattactgaatgcacactatatgccagacattgttctaagtgctttatatgtagtaacttgtttaatattcaaaacattatgaagaaaccatggcccaaaaaggtgaagtaatttaatccaaatcacattgctattaagtggtgggcctggacttaaacctaggtagtgtaaaccaaaaataaaattctaaggcttccaaccatctaaatagacttccccttcagccagggcttttttctttcttttcttgttgtttttttttttttttaaagagacaataaaaggaggtttttttattcaaaggtataactggataagtagatttgtttacaatcattcttgtgaaatacttttttaaaaaaatacgatcaacttctttgcaaatagtagacacatacctcaacaatgatgacctaatttttgatccataatgtaagattaggtagaaataggcaagctcacactgctaaattaactatcaaatactcagtcaaaactccatttgtggcccccacttcttgatctatttctgttccacttcgtcttctaccatcttgccgactttcctgagcaactgctttgtcgactctctctacctgaccaattgccagatcgacaacctgactggcctgaccagccactcctctgtctggaattaaaagatgtttccatcataatattctttaatttcaggtaatttagctggcactgagagtatccagccggaatcatgccactttgcctgtaacctttgactcaattggaggaatatcaaagcaaacacccatatttcctttcaggaggcacactctggtaatctgagacactgcattactattcagctttctaagttctttccaagcacagctgacatcctgtatttcctctaggctttccagagtcatggtcacaaaccccttatcagagttgattaaagatcatggttcaaagcttgatacaccagaaatgtgggctaaagctgcagccaatgcatctatcgcccctttctcttctatcagtatctgagctgatggttggaaaaaaatcaacagcagcataagaaatggaagccagagaccttatggcatccatgcttttaaatttaactaaatccattgtagaaggaacacctacacatttaaaagtaatttgtgttttttgttccacatgtcttagttgacctttctcttggttgataaaaacatatacaaacccctgtctgtccagctttacccacgcatccagagagatggatataggactcaatatcctgaggaggagaactttgaatcaccaggtcaactacaggaatgtccaaaccacgaggagccacattggttgccaccaaaactttataattacctctctgaagccttttagtgtaatttctctttgtgactgtgcaatgtccccatgtaaacacagtgcattctgttttgtgcggattcatggccatgtcagttacattcttcttcgtctcacagaaaataatagccctcccttcagatccactgtagacttgaaggacatctcattttcatctgtgttttataaaggaggaaattgaggacctcacatggagggactggaatttaaaaccaggtcttctgactttaaggcctttcttttagtgttttcccttttcttttccttaagtcactaaaatctgtagttatataatcttacataaagcatatgcaaaatagaaaaatgatagtcaccacatatctactaatgggattaaaatgtacaatcctaaaagcttacttgttagcacacttgcttatctgtccattcattcattgaaccagtaagtatttattgagagttagtgggaatacaatgctgtgcaagacaaacaagatccctccattcataccacttaaattctagtggggaaaacatctgcacataacaaactaaataaaatgatcataaaataataaatgctatttatataaaactggctactttcattactgctcagttaaagggtcttgtagctcattttatgacatgaaaaaaatcaaggtctaaaagctccttgagacaatttaaactctaataccaaatatacctctataaaataccaaactgagctaaatacggtatatgtgtacttatacatatgtacataacctaaatatacgtgtgcacacattatctatacaaagagccatactcagtgaaagataaattacctcctaaactaaagtcccctctgaggtacaacagaaattaaaataattgcttctcttctcaactctatgtagcacgtattttccatgatgggataaatgttttcatttcaagtgccaatgtgtgaactgtaataaacattactgctttc

SEQ ID NO: 175974 - DNA, 3769 bp, Homo sapiens
  Payload ID: 14550
  Gene Symbol: ARHGEF39
  Gene Name: Rho guanine nucleotide exchange factor (GEF) 39
  Uniprot ID: Q8N4T4
  ENST ID: ENST00000378387
  CDS Start-End: 119-1126
atgctccttcctgcgcgctgccctccccggccccgcctccgcggctcccgcccgcgagcggttgggatttgaatctgccgcggactgcagccggaagtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctaaagaaaaataaaggtttccggaggtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacgggctgcccgactgataagtgagactgcccagagagtccatactattggtcagaaacagaagaatgaccagcaccttcggcgtgtccaggctctgctcagtggacgccaggcaaaggggctgacctcagggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtggtgggttgctcagtctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccactggatttgagtaaagttttttttcttttttttgggaaagacccttctgtctcagttttgctatgagaaaagggatttttgggccctgaacgcgggcatgctggtggcctcaggaatacgaggaaaagagctggagctccctctatcttctctgctgtcacactggaaggcagcctctttttgtcctaataaggacagctcttcaagaaggcccagttgtccttaggcacctagtatgggtgtgtacaaccaactaggatcgaaaaaacacacaggagcactccatcatgaaaacagactttgttttagtcgaccttcagctgtcgtccctccttcccagccaaggctgtgactggggccctttgccacagcctggctgcaccttctccgtagtccccgccccacctcccaggaagtagctaggttccatgtctctgtgctccagtttgtgggctcctcccaggcctgactgtcaccaatctcctcctcgtcctcctttaaacagaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaaggtgggtggatcacctgaggtcaggagtttgagaccagcctggccaacacggtgaaaccctgtctctattaaaaatacaaaaattagccgggcgtggtggcaggtgcctgtaatcccagttacttgagaggctgaggcaggagaatcgcttgaacctgggagccagaggttgcagtgagccgagattgcgccgctgcactccagcctgggtgacagagcgagactccatctcgaaaaaaacaaaaactttggttgttagacagttcatgcacaaagccaaaatttgtcctttatgtatcttctttccatagtgcttactggagccttccaaaataatgtctcctcaaggtgacagcccctcaggaatttgaaggcaatggtcacaccctcacccactttcctgagttttttctggtttattaacgtcagtctttacagtcagtgctcattgacggtggttttctctggttgtttcctgaacacgtagtgctcttaaagcaatgccctgaggagaatacaattctccaggggcattctgattggcaggtgaagcacagtgccatgttcccagcactgatttgggaagtggcttgtcacatcccacagtgaactcagtcaactggaatgcctaactctctttcataagacctcctgctacattatgtttctcccagactgtactcaggtccaagaacagaatttactagtctatccttctcaaagttcatcattaaattcagtcattcatcct

SEQ ID NO: 175975 - DNA, 2862 bp, Homo sapiens
  Payload ID: 14550
  Gene Symbol: ARHGEF39
  Gene Name: Rho guanine nucleotide exchange factor (GEF) 39
  Uniprot ID: Q8N4T4
  ENST ID: ENST00000475323
  CDS Start-End: 24-584
agtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctaaagaaaaataaaggtttccggaggtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccactggatttgagtaaagttttttttcttttttttgggaaagacccttctgtctcagttttgctatgagaaaagggatttttgggccctgaacgcgggcatgctggtggcctcaggaatacgaggaaaagagctggagctccctctatcttctctgctgtcacactggaaggcagcctctttttgtcctaataaggacagctcttcaagaaggcccagttgtccttaggcacctagtatgggtgtgtacaaccaactaggatcgaaaaaacacacaggagcactccatcatgaaaacagactttgttttagtcgaccttcagctgtcgtccctccttcccagccaaggctgtgactggggccctttgccacagcctggctgcaccttctccgtagtccccgccccacctcccaggaagtagctaggttccatgtctctgtgctccagtttgtgggctcctcccaggcctgactgtcaccaatctcctcctcgtcctcctttaaacagaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaagggcctcctcccaaggagaacatgagaccacttcatatctggaactctagaaacactggctgcagcaatcaacctcctgtgccaaggctggccccactcttgtagcatggacactgctagctgggttcaaatcccagctccagcagttgccagcgctgggtgacctcgagcaagtgactactcctcactggattgtaggagaactaaatgtgatagtcattatttacagttcaccacacgctcttcacatccgttacctccctggatcctcaaaataacctcataatattggaaggcc

SEQ ID NO: 175976 - DNA, 4498 bp, Homo sapiens
  Payload ID: 14550
  Gene Symbol: ARHGEF39
  Gene Name: Rho guanine nucleotide exchange factor (GEF) 39
  Uniprot ID: Q8N4T4
  ENST ID: ENST00000490638
  CDS Start-End: 2152-3051
agggggcgcagggccgggcagaaggcggcgagctgggggcggatatccaccggggactggaagcggcccgcgcaggctggggacacccggggccagggcgggtcgcctggggtgggagagtatagtgaggaagtctgacgcctaggtcaggaacttagggaacccgggtagaaaaggtgagggggtgggacggtgggcggcgggtgggacgcccgggaccagtgttcagggacggctgtaggggagatccacagagctgggttcccagattgggtctgtgcagcgggtgggtgtctcacctccatagcgccaatgactctggtcatcccctgtataaatgaaaaggatgaaccgctcaagcttagagccccaatcccttcctggcgaccaaaacgatgtcacaaacgcagatgccttacaggagcattacgggtaacaaatgccttaagcgggccaggtgcaaagcacaggagaccgcacccaaactcaacaccgcagctgggtgggccaaacagcaatcctaccagcttgcaatcattgtcttagggtctgtaaaagtgagtggctgcttcaggccaggcgctgtggctcacgcctataatcccagcactttgggaggccagggtggttggatcacctgagatcaggagttcgagaccagcctgaccaacatggcgaaaccccgtctctactaaaaatacaaaaattagccgggcgtggtggcgcatgcctgtaatcgcagctacttggctagaggctgaggcaggagaatcacttgaacccgggaggtggaggttgcagtgagccgagatcgcgccattgcactccagcctgggcaacaaaagtgaaagtttgtctcaaaaaaaaaaaaaaaaaaagtgagtgggcacttcagtcctgagtcccaaatgagtgagtacaccatctttcctttctcccttctttcttctccccactcatccctctgccttgtatggtctccaacccctttccccaaattcctggcttgggagtcaagaagccacgtttctctacctgctgtgtcccttcttcctaggtctcaatttcctcattgtagcctaagatgagatgacttctaccagctcttcttgcttgtctctggtacccacttcacctcccaagctttccttttctcttcccctcaaactctctgactctccttctccacctatttttttcctctgtctgcacattttttctctcatctgcagttctcatccctttctcttctccagcctcccccttctctcccatctcatccagctcacctctctccttttgcaccctttttattttctctccacatctgtccctttctacctccgagagtggggatggggatattggtatgggacctctggaagggcttctgtggggagtacagtctcccctccttccctgagtgaacagagcctaggctggggtatgggaggggagtcatgaacctcctggaacctggatttggagattgatgaccacttaccttctttgtccctgtgggcattattctggggttcttgaggatctccaggagcctcaacagtaggtagatcctctaacttcagggagccctcttcttctgatttaggcttaacttcaggtagatcctcctctccaggtagatcctcctctccaggtagatcctcctctccgggtggatcctcctctctgggtgaatcctcttcactgggcagatcctcctcgcccagtgggtcatcttccccagaagagcctcctcccaagggggaatcctcctgcatccggggcaacctctggggatggacaggcaccagaagcagcagtgacagcagcagttgcacagtgaggcctggagcaggggccgggatcaacagagggagccaggggctggggcacaggggagccatgcggctgactgtggggtgtcccagcacacggtgtgtacgggctgtacgtgcattggaaacgagagctgggtgggggaggagcaagcctggaggggagcaggctgactcacagagcgcccttttgcagagatggagccaaagtctcacagctcactcatttttcaaatgcgattccctatggctctgtttctctgtctctctcgtctctggtctgagtggagaatgtggactctgaccctggatcatgctgggagtctgccaaaccctcaaacagtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctaaagaaaaataaaggtttccggaggtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacgggctgcccgactgataagtgagactgcccagagagtccatactattggtcagaaacagaagaatgaccagcaccttcggcgtgtccaggctctgctcagtggacgccaggcaaaggggctgacctcagggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtggtgggttgctcagtctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacaaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaagggcctcctcccaaggagaacatgagaccacttcatatctggaactctagaaacactggctgcagcaatcaacctcctgtgccaaggctggccccactcttgtagcatggacactgctagctgggttcaaatcccagctccagcagttgccagcgctgggtgacctcgagcaagtgactactcctcactggattgtaggagaactaaatgtgatagtcattatttacagttcaccacacgctcttcacatccgttacctccctggatcctcaaaataacctcataatattggaaggccaa

SEQ ID NO: 175977 - DNA, 3656 bp, Homo sapiens
  Payload ID: 14551
  Gene Symbol: ARHGEF4
  Gene Name: Rho guanine nucleotide exchange factor (GEF) 4
  Uniprot ID: Q9NR80
  ENST ID: ENST00000326016
  CDS Start-End: 520-2592
agaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaa

SEQ ID NO: 175978 - DNA, 1872 bp, Homo sapiens
  Payload ID: 14551
  Gene Symbol: ARHGEF4
  Gene Name: Rho guanine nucleotide exchange factor (GEF) 4
  Uniprot ID: Q9NR80
  ENST ID: ENST00000355771
  CDS Start-End: 13-1872
tagagagaggaaatgaggccagatgggcagcaagctttggatgctgtggtaaggagttttgactgtcactctgaagcagctctcaggcagaggaatgatgtgatttattgtagtttaccaaggaccgctcagggtattgtgcagagggaagaccagctggaggttcttgtgtcactccgtgaagtgtgggggcggcggaggggcagagatgggacctgcactggagccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtga

SEQ ID NO: 175979 - DNA, 3664 bp, Homo sapiens
  Payload ID: 14551
  Gene Symbol: ARHGEF4
  Gene Name: Rho guanine nucleotide exchange factor (GEF) 4
  ENST ID: ENST00000392953
  CDS Start-End: 619-2781
agaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagccaggcgcaagcatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 175980 - DNA, 4788 bp, Homo sapiens
  Payload ID: 14551
  Gene Symbol: ARHGEF4
  Gene Name: Rho guanine nucleotide exchange factor (GEF) 4
  ENST ID: ENST00000409359
  CDS Start-End: 1199-4243
attccccaggctgagagtacgcgagggcgcagcagcggcaaggggctggaactggggtcggggctgttgggctcctgctcggggtgccccctctctggcccgatttccgggcccgctcaccatccgggacccactcagttgggacgcctccacctcgctgcccccacaggaaccccaagatgggccgggggctccggggcactgtcaggggtggccggccacaggttgccaagcccgacctccccagactccagagccaggtgcacacctgccaggtgaaggtgagattgaagataaccagctccccacatcccctgcagaacaagtggagcagggatggaaccagcaaacagaccgcgatgattctgaaacgctgtcccagcagagtgaaagtggatcagacacaaaaactgacccctttgaaagtgcctctgacacagagtccttgtctgggtacctcccgaggggagtcttccaccctctaagaggtactcccgtagatatagaagcaccttgggaataccctgatgtctcagcaactggaccccctcaggagcagcatttgaccagtgttcctgggcttcatgcaaaggaagaactcgatttgtcccctagcttagaggatgactcttgcaaaaatgggtggcgagcctttgccacagttgctggagaacaggaggcaggacacctctgggactgcgcgaccagcctggagcgagagtctttgctggcaggggttccccgacacacagggtgctgcttacagagggccacagacagcagtggtcctgagccagtacagggggtggctgttcaagacctcagagggctctccagtgtttctcttcagaaatccaggtctgagagctatctgggcatcccagtggtctggcccttccttctctggtgctgtgaactgggtcggagttggccacatatccacaacagggccagggcactggtgctacctagcagaggcccactggacaacacagcccctctggggaccaggacaaagaaggaaagtactctaggccctgcaggggacacagaattgctctggtcccagccccactcggatgtcccctgccagcctcctttgaggacatcttgcctcctacgcaccaaccgtcaccatagtgccccagaaactactggtgacaagaacagggcatcccccagactcaactgtgggcacatgagggcactggtcagggcccattccatagcagggttttcaccagagtgccccgaggatcccgtgggacagaatgttgtgaagtctgggacccatgtgaaggaaggggccaaaaatgaacgagatccaagaatacaaaacatcccttcccctgcacccacccagctgtctggcccgattcctgcttttcagagtggggctccccatctgcagggtccctgcaagcctggtgggtttcgcttgcaaagggcctctcaggacactccttctgcaggtctcctgggggaaaaccagttaagacaggattccaggtcatgtctggtggcttcatgcctcacctcagagttagtgaagctcagtgcagaggaagtgcctgagcccgctgagtgcaagtcagagcaaagcccagaaagcagaacccaggaaccccaaggcacccaactcgcaccaagagctgctgatgagagagagacacagaagcacctctggggcatttctgtccaggcaggaaaccaaaccagtaattacacatcaaagtatgtgctcagcgaggaaagcaagtcacctaccagggccaagttcccacggcagcctagcagtgaggggacccaggtgtggagtggagacttgatgggctgcttggaagtgagtgacagttcagatgcccctgagaccacccagaaatcaagcgcaatagacacttcaaaggcagccgaagaagccatggttctagaccccaactacagggaacaggctttgcaaggtctttcagaattcaaggcagccacggtgtctcactgcggccccggggctgaggagggtgaacaggggcctgggggtgccgggggccggcagctggagcccaaagcaggcggcgaggcctcgaggggcaggggcgccctcatcattgtagctgtggagcagaaaggtcttcaggccagcaggagcaatgcggggcctgttccagaaacactgccccgtgactttcctaaggaaagaccagaatctcccttgagcactggcgagaccccctgtgagtctcccactagggggaaaacaccagccggtaatgagtgtgagttgccagcagcccccatacagggagctggcgatggggctcttcagcgggtggcccaggccgcagagcttgggagagtgctggtcccccaagctgcttcggaagagacgccgagcacagaggagcccccgggagagagactgcgtggggagagccggagctccgggtcaggggagcgtggcccggaggaggcccccgaaggcggtgctgcagcagcccggggccagcgcccccgcgtccccgccttggagccgccccagccgccacgcgggctccgcaagggcgcgcaggagcctgggaagcgcccgacgttttccaaggtgacctccttcaggaagggcaggcccttggccactgagagcccaggaggggtcccggccccgaccaccgagggtcgccgctggggctcttcaggccccgaggggctccccagggagaatccgcccgctgcggccggtcgggacgcaccgcctctgcaccacggggacgccagcgcctggcccgagtttgtcccgcaggctgcaggcgacaggactgcagggccggcaggagcggggcacacggggacctcaggggatcttggtagccgagggccttcctctgagagctgcaacgcaaagagactcaaaacaacggagaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcggtaggtacctaccttcaggtatctttccggaaaagtcctggctggcgtcccccggcagccctcgggcccagcaggctggaatcgcacacaccctgccttccagctctgcctgctgcctggcatatgaaaaccccgggacgccctgcagacccacgagccccaagcccctgagtcccaggcctagtgctcagcggatgggtctccactaccccgggaggggtagcgccatctccatggtttctcttggaagctacagctacgtggacagcagttcaggggaccctgaaagacccaagattcccaagggccagaccagtttcctgctttctctgcagacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactggtgagttacgcgcctctctcttttgctatgtactctggatcctggcatgaaggacaagaagctagtgctgttggcagctgtatccacttgcctggtagaagtagcttgaaggtgagagagataaacaattgtcctcttccttcagttagggaggagtgcctactacccaaagaaagggaattattggctgggcacagtggctcatgcctgtaatcccagcactttgagaggctgaagcaggcggatcacttgaggtcaggagctcaagaccagcctgggcaacatggtgaaaccccatctctactaaaaatacaggccgggtgcggtggctcatgctataatcccagcactttgggaggccaaggtgggcggatcatatgaggtcgggagttcgagaccagcctgaccagcatggagaaaccccatctctactaaaaatacaaaattagctgggcatggtggcacatgcctgtaatctcagctactcgggaggctgaggcaggagaattgcttgaacctgggagtcagaggttgcggtgagccaagatcacgccattgcactccagcctgggcaataagagcaaaactccgtctc

SEQ ID NO: 175981 - DNA, 1893 bp, Homo sapiens
  Payload ID: 14551
  Gene Symbol: ARHGEF4
  Gene Name: Rho guanine nucleotide exchange factor (GEF) 4
  ENST ID: ENST00000409303
  CDS Start-End: 1-1893
atgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtga

SEQ ID NO: 175982 - DNA, 1638 bp, Homo sapiens
  Payload ID: 14551
  Gene Symbol: ARHGEF4
  Gene Name: Rho guanine nucleotide exchange factor (GEF) 4
  ENST ID: ENST00000438985
  CDS Start-End: 1-1119
ccacttgcctccacacctttgtcctccagtttagtttctccagaacacaggaggaaaagtgaaccgaccatcaagtgcacagccacccaggaaggcggtaggtacctaccttcaggtatctttccggaaaagtcctggctggcgtcccccggcagccctcgggcccagcaggctggaatcgcacacaccctgccttccagctctgcctgctgcctggcatatgaaaaccccgggacgccctgcagacccacgagccccaagcccctgagtcccaggcctagtgctcagcggatgggtctccactaccccgggaggggtagcgccatctccatggtttctcttggaagctacagctacgtggacagcagttcaggggaccctgaaagacccaagattcccaagggccagaccagtttcctgctttctctgcagacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaat

SEQ ID NO: 175983 - DNA, 2172 bp, Homo sapiens
  Payload ID: 14551
  Gene Symbol: ARHGEF4
  Gene Name: Rho guanine nucleotide exchange factor (GEF) 4
  ENST ID: ENST00000428230
  CDS Start-End: 520-1098
agaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 175984 - DNA, 3800 bp, Homo sapiens
  Payload ID: 14551
  Gene Symbol: ARHGEF4
  Gene Name: Rho guanine nucleotide exchange factor (GEF) 4
  Uniprot ID: Q9NR80
  ENST ID: ENST00000525839
  CDS Start-End: 75-2087
gggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaaggtaggcggacagcagccccacctcctcggctgcccggtccttaccctgctgacatcattcccttctctgaaccacaaagccaagccagctagccaccaggcctgaggggggcccactgccctttgcagctgtttgttcccaaaggttggtaataaggggccactggggaagcctgggtcagtatatggttgacattcttactctcaacaccttggctcccccagatcagggccattggtgacaatgcttgtttccccagggttccttcctgacaggcatctggggttggtgtagggatggagctgctttccccatttctacagagagccatgcccctgaaacatcacatgcctttgcacaggccacccccctcttcaggctgctgcaggaggccaggcccaggccagagaccccaggcagcctgagctcttggatgtggtcagctctccaggagcaagtcctgtgtggcaaaactgcctcctacggcggctctgaagcagagccctgggacggaccccatgctgtccccaacagctggggtggcactctgccctgggcacccatgaccctctgctgtctctccctgttcagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagt

SEQ ID NO: 175985 - DNA, 882 bp, Homo sapiens
  Payload ID: 14551
  Gene Symbol: ARHGEF4
  Gene Name: Rho guanine nucleotide exchange factor (GEF) 4
  ENST ID: ENST00000532720
  CDS Start-End: 1-862
cgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaaggtaggcggacagcagccccacctcctcggctgcccggtccttaccctgctgacatcattcccttctctgaaccacaaagccaagccagctagccaccaggcctgaggggggc

SEQ ID NO: 175986 - DNA, 3486 bp, Homo sapiens
  Payload ID: 14551
  Gene Symbol: ARHGEF4
  Gene Name: Rho guanine nucleotide exchange factor (GEF) 4
  ENST ID: ENST00000611048
  CDS Start-End: 520-2412
agaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 175987 - DNA, 5919 bp, Homo sapiens
  Payload ID: 14552
  Gene Symbol: ARHGEF40
  Gene Name: Rho guanine nucleotide exchange factor (GEF) 40
  Uniprot ID: Q8TER5
  ENST ID: ENST00000298694
  CDS Start-End: 128-4687
gagccgccaccgcggccggagctgtcccttagccagacccggcgagacacgagcggcgggagggaggcggtggcgcgcccggccccgcccgcccgaccaagcgtcggacgcggcccggcgccgagccatggagcctgagccagtggaggactgtgtgcagagcactctcgccgccctgtatccaccctttgaggcaacagcccccaccctgttgggccaggtgttccaggtggtggagaggacttatcgggaggacgcactgaggtacacgctggacttcctggtaccagccaagcacctgcttgccaaggtccagcaggaagcctgtgcccaatacagtggattcctcttcttccatgaggggtggccgctctgcctgcatgaacaggtggtggtgcagctagcagccctaccctggcaactgctgcgcccaggagacttctatctgcaggtggtgccctcagctgcccaagcaccccgactagcactcaagtgtctggcccctgggggtgggcgggtgcaggaggttcctgtgcccaatgaggcttgtgcctacctattcacacctgagtggctacaaggcatcaacaaggaccggccaacaggtcgcctcagtacctgcctactgtctgcgccctctgggattcagcggctgccctgggctgagctcatctgtccacgatttgtgcacaaagagggcctcatggttggacatcagccaagtacactgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtcccttaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccgcccgcacccgggcctccgtggccgtgtcatcctttgagcatgccggcccctcccttcccggcctttcgccgggagcctgctccctgcctgcccgcgtcgaggaggaggcctgggatctggacgtcaagcaaatttccctggccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgagaacttgcttggctgtttgttaaatgctaattcttgggccccatcagagctactgcatcgaaacctgggggtaaaacccaatattctgcatttcttatcaaactctttgggtgataactaagtgtctgaagaggtgactatttcctgacagaaggacccaaagagggaagcaggacataggtaggcagacagacacagggccctgtgcctcaagacacctgtttattggggacacgactctgcaatagggatgacaggaatcgtaccaaaaatagcgacgtctacagggcccctgatggggctagaagggtacagtgccccccaccctcaccccttgtacaaaaataaactctcacgcctatgga

SEQ ID NO: 175988 - DNA, 1796 bp, Homo sapiens
  Payload ID: 14552
  Gene Symbol: ARHGEF40
  Gene Name: Rho guanine nucleotide exchange factor (GEF) 40
  ENST ID: ENST00000555038
  CDS Start-End: 125-1796
ccgccaccgcggccggagctgtcccttagccagacccggcgagacacgagcggcgggagggaggcggtggcgcgcccggccccgcccgcccgaccaagcgtcggacgcggcccggcgccgagccatggagcctgagccagtggaggactgtgtgcagagcactctcgccgccctgtatccaccctttgaggcaacagcccccaccctgttgggccaggtgttccaggtggtggagaggacttatcgggaggacgcactgaggtacacgctggacttcctggtaccagccaagcacctgcttgccaaggtccagcaggaagcctgtgcccaatacagtggattcctcttcttccatgaggggtggccgctctgcctgcatgaacaggtggtggtgcagctagcagccctaccctggcaactgctgcgcccaggagacttctatctgcaggtggtgccctcagctgcccaagcaccccgactagcactcaagtgtctggcccctgggggtgggcgggtgcaggaggttcctgtgcccaatgaggcttgtgcctacctattcacacctgagtggctacaaggcatcaacaaggaccggccaacaggtcgcctcagtacctgcctactgtctgcgccctctgggattcagcggctgccctgggctgagctcatctgtccacgatttgtgcacaaagagggcctcatggttggacatcagccaagtacactgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggtcagtgggcatcagtgggtgaagggaaacaggactgggaaagagaagcaattg

SEQ ID NO: 175989 - DNA, 4902 bp, Homo sapiens
  Payload ID: 14552
  Gene Symbol: ARHGEF40
  Gene Name: Rho guanine nucleotide exchange factor (GEF) 40
  ENST ID: ENST00000556399
  CDS Start-End: 107-1615
ctgtcccttagccagacccggcgagacacgagcggcgggagggaggcggtggcgcgcccggccccgcccgcccgaccaagcgtcggacgcggcccggcgccgagccatggagcctgagccagtggaggactgtgtgcagagcactctcgccgccctgtatccaccctttgaggcaacagcccccaccctgttgggccaggtgttccaggtggtggagaggacttatcgggaggacgcactgaggtacacgctggacttcctggtaccagccaagcacctgcttgccaaggtccagcaggaagcctgtgcccaatacagtggattcctcttcttccatgaggggtggccgctctgcctgcatgaacaggtggtggtgcagctagcagccctaccctggcaactgctgcgcccaggagacttctatctgcaggtggtgccctcagctgcccaagcaccccgactagcactcaagtgtctggcccctgggggtgggcgggtgcaggaggttcctgtgcccaatgaggcttgtgcctacctattcacacctgagtggctacaaggcatcaacaaggaccggccaacaggtcgcctcagtacctgcctactgtctgcgccctctgggattcagcggctgccctgggctgagctcatctgtccacgatttgtgcacaaagagggcctcatggttggacatcagccaagtacactgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacggcctggccattttgtgtcttcaggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtcccttaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctct

SEQ ID NO: 175990 - DNA, 5204 bp, Homo sapiens
  Payload ID: 14552
  Gene Symbol: ARHGEF40
  Gene Name: Rho guanine nucleotide exchange factor (GEF) 40
  ENST ID: ENST00000553709
  CDS Start-End: 81-1943
cacgagcggcgggagggaggcggtggcgcgcccggccccgcccgcccgaccaagcgtcggacgcggcccggcgccgagccatggagcctgagccagtggaggactgtgtgcagagcactctcgccgccctgtatccaccctttgaggcaacagcccccaccctgttgggccaggtgttccaggtggtggagaggacttatcgggaggacgcactgaggtacacgctggacttcctggtaccagccaagcacctgcttgccaaggtccagcaggaagcctgtgcccaatacagtggattcctcttcttccatgaggggtggccgctctgcctgcatgaacaggtggtggtgcagctagcagccctaccctggcaactgctgcgcccaggagacttctatctgcaggtggtgccctcagctgcccaagcaccccgactagcactcaagtgtctggcccctgggggtgggcgggtgcaggaggttcctgtgcccaatgaggcttgtgcctacctattcacacctgagtggctacaaggcatcaacaaggaccggccaacaggtcgcctcagtacctgcctactgtctgcgccctctgggattcagcggctgccctgggctgagctcatctgtccacgatttgtgcacaaagagggcctcatggttggacatcagccaagtacactgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcagtttagggttattcttttctgcccttaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtcccttaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccgcccgcacccgggcctccgtggccgtgtcatcctttgagcatgccggcccctcccttcccggcctttcgccgggagcctgctccctgcctgcccgcgtcgaggaggaggcctgggatctggacgtcaagcaaatttccctggccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcaca

SEQ ID NO: 175991 - DNA, 5544 bp, Homo sapiens
  Payload ID: 14553
  Gene Symbol: ARHGEF5
  Gene Name: Rho guanine nucleotide exchange factor (GEF) 5
  Uniprot ID: Q12774
  ENST ID: ENST00000056217
  CDS Start-End: 175-4968
gaaacttcctaggagaacccgatccctccctcccgtcgggcggccaggggcgggccgcgggtggggcggccgggcctgcgctggggacggctctggggactgcggccggcgccgggacctggaggggacgctggggccgaagcagcatgtgacaccgaccaggattcagccctgatggaggctgaggaggcccagcgtggagcctctcctcccatctctgccatagaggaattcagcattatccctgaggctcccatgaggagcagccaggtctctgccttggggcttgaagctcaagaagatgaggacccatcctataagtggagagaggaacacagactctcagcaactcagcagagtgagttaagggatgtgtgtgactatgcgattgagacgatgccctcttttcccaaggaaggttctgcagatgtggagcccaatcaggaaagccttgtggctgaggcctgtgacactccggaacactgggaggcagtaccccagagcctagcaggccgacaagcaaggactctagctcccccagagctctgggcctgccccattcagagtgagcatctagacatggccccattttccagtgacctgggaagcgaagaagaggaggtggaattttggccaggacttacttctttgacattgggatctggacaggcagaagaagaagaggaaacctcttcagataactctggtcagaccagatattattctccctgcgaagagcatcctgcagagaccaaccagaatgaaggctctgaaagtgggactatcaggcagggggaagagctgccacctgaggagctgcaggaaagtcaagggctcttgcatccccaggaggtccaagttctggaggagcagggacagcaggaagcaggatttcggggggaaggaactctgagggaggatgtttgtgccgatgggctattaggggaggaacagatgatagagcaggttaatgatgaaaagggagaacagaagcaaaaacaggaacaggtacaagatgtgatgcttgggagacaaggagaaagaatggggctcactggggagccagagggtctgaatgacggtgagtgggagcaggaggatatggagaggaaggctcagggtcagggaggtccagaacagggagaagagaggaagagggagctgcaggtgccagaagagaatagggcggactctcaggacgaaaagagtcaaacctttttgggaaaatcagaggaagtaactggaaagcaagaagatcatggtataaaggagaaaggggtgccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcatgactcagattcccgggactcagacagagtccagggctgaggaactgtcccccgcagctctgtctccctcgctagagcccatcaggtgctctcaccagcccatttctctactgggctcctttttgactgaggagtcacctgacaaggaaatagatcaaaacagccagcaagaggaatccaggctgaggaagggaacagtgtccagccaagggactgaggtggtctttgccagtgcatctgtgactcctccaaggacaccagattcagctcctcccagtcctgctgaagcctaccccatcacacctgcctcggtatctgccaggcccccagttgcctttcccaggagggaaacctcttgtgctgcacgtgctccagaaactgccagtgcccctctctcaatggatgacccatctccctgtgggacttctgagatgtgcccggctgccctctatggcttcccctccaccgggaccagccctccgaggcccccagccaactccacaggcaccgtccagcacttacggagtgactccttccctggttctcacaggacagagcagactccagacctggtgggaatgttgctttcctactcccactcagagctgccccagaggccccccaaacctgccatctacagctctgtgaccccaagaagggacagaaggagtggtagggactacagcaccgtttcagcatcccctactgccttatccacgctgaagcaggactctcaagaatccatctcaaatctagagagacccagcagtcctcccagcatccagccctgggtctccccacataatccagcctttgccacagagtctcccgcctacggttcttccccatcctttgtctccatggaggatgtgaggatccacgaacctctgccccctcctcccccacagaggagggacacccatccctccgtggtggagacagatggccatgctcgtgtagtggttcccacgctgaagcagcatagccaccctcctccattggccctaggttcagggctgcatgccccccataaaggcccacttccccaagcctctgaccccgctgtggccaggcagcaccgacctctgccatctaccccagacagctcccaccatgctcaggccacccccaggtggagatacaacaagccgctaccccctacccctgatttgccgcagccccaccttcctcccatttctgctcctggtagctcaaggatctacaggcctctacccccactacccatcatagaccctcccaccgaaccacccccattgcccccaaagtccagggggaggagcaggagcactcggggaggacatatgaactcagggggtcatgccaaaacaagacctgcttgtcaagactggacagtccccctccctgcctctgctggacgcacctcctggcccccggccacagctagatcaacagagtctttcacttccaccagcaggagtaagagcgaagtgtcccctggcatggctttcagcaacatgacaaacttcctatgcccctcttcccctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgagggggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggaactaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcaaagtgaaaagcttcggtggatctcagccttggccatgccaagagaggagttggaccttctggagtgttacaactccccccaggtacagtgccttcgagcctacaagccccgagagaatgatgaattggcactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagctcaaggacaaaatccagctaacccagtccctcggcccaggcctcctttcgtgctttgtgcttggtgggggggatttcgagggactttgcactggactctgggaacctttcatcattaaaaaaagggggaccattggggcctgagccaaggaactttccttctactgccttatagtgcttaaacattctccgcctccagggtgcagattcagagctggccagagtttcagtgatagccgtatgttaaacagaatctcacctcagtctcctggagggagatgtttaagaggggttaacacatcagatgggagggtcagcccggtgacctctaaggtatcttctaacctagaaattcaccataattatggtgcaaggtcagtgtgtctctgagatctatgtctgttggtggcaatgtgagggtgatactctctcactctaataaacttggcacttctccgagta

SEQ ID NO: 175992 - DNA, 771 bp, Homo sapiens
  Payload ID: 14553
  Gene Symbol: ARHGEF5
  Gene Name: Rho guanine nucleotide exchange factor (GEF) 5
  ENST ID: ENST00000498580
  CDS Start-End: 227-771
gcggaggggccctgcccctcctccgggaaggtgtgtccctgtttcctcacctgaaacttcctaggagaacccgatccctccctcccgtcgggcggccaggggcgggccgcgggtggggcggccgggcctgcgctggggacggctctggggactgcggccggcgccgggacctggaggggacgctggggccgaagcagcatgtgacaccgaccaggattcagccctgatggaggctgaggaggcccagcgtggagcctctcctcccatctctgccatagaggaattcagcattatccctgaggctcccatgaggagcagccaggtctctgccttggggcttgaagctcaagaagatgaggacccatcctataagtggagagaggaacacagactctcagcaactcagcagaattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaaga

SEQ ID NO: 175993 - DNA, 1862 bp, Homo sapiens
  Payload ID: 14553
  Gene Symbol: ARHGEF5
  Gene Name: Rho guanine nucleotide exchange factor (GEF) 5
  Uniprot ID: Q12774
  ENST ID: ENST00000471847
  CDS Start-End: 303-1862
gaaaaggccttctgtacttgtcccagtcccatcctgacccgtggctcgggacgtcactggtactgatctctttcacgctctctgctttgccactttcttccctcccagtttcccaataaagcccattttcccttctggacccctgcatctcctgctctagatcttctttggctctctctatccctctgaaatctcagttatcttccccatttccacttttagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggaactaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcaaagtgaaaagcttcggtggatctcagccttggccatgccaagagaggagttggaccttctggagtgttacaactccccccaggtacagtgccttcgagcctacaagccccgagagaatgatgaattggcactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaa

SEQ ID NO: 175994 - DNA, 2968 bp, Homo sapiens
  Payload ID: 14553
  Gene Symbol: ARHGEF5
  Gene Name: Rho guanine nucleotide exchange factor (GEF) 5
  ENST ID: ENST00000474817
  CDS Start-End: 1-2393
gtgtagtggttcccacgctgaagcagcatagccaccctcctccattggccctaggttcagggctgcatgccccccataaaggcccacttccccaagcctctgaccccgctgtggccaggcagcaccgacctctgccatctaccccagacagctcccaccatgctcaggccacccccaggtggagatacaacaagccgctaccccctacccctgatttgccgcagccccaccttcctcccatttctgctcctggtagctcaaggatctacaggcctctacccccactacccatcatagaccctcccaccgaaccacccccattgcccccaaagtccagggggaggagcaggagcactcggggaggacatatgaactcagggggtcatgccaaaacaagacctgcttgtcaagactggacagtccccctccctgcctctgctggacgcacctcctggcccccggccacagctagatcaacagagtctttcacttccaccagcaggagtaagagcgaagtgtcccctggcatggctttcagcaacatgacaaacttcctatgcccctcttcccctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgagggggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggaactaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagaaagtgaaaagcttcggtggatctcagccttggccatgccaagagaggagttggaccttctggagtgttacaactccccccaggtacagtgccttcgagcctacaagccccgagagaatgatgaattggcactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagctcaaggacaaaatccagctaacccagtccctcggcccaggcctcctttcgtgctttgtgcttggtgggggggatttcgagggactttgcactggactctgggaacctttcatcattaaaaaaagggggaccattggggcctgagccaaggaactttccttctactgccttatagtgcttaaacattctccgcctccagggtgcagattcagagctggccagagtttcagtgatagccgtatgttaaacagaatctcacctcagtctcctggagggagatgtttaagaggggttaacacatcagatgggagggtcagcccggtgacctctaaggtatcttctaacctagaaattcaccataattatggtgcaaggtcagtgtgtctctgagatctatgtctgttggtggcaatgtgagggtgatactctctcactctaataaacttggcacttctccgagt

SEQ ID NO: 175995 - DNA, 5233 bp, Homo sapiens
  Payload ID: 14554
  Gene Symbol: ARHGEF7
  Gene Name: Rho guanine nucleotide exchange factor (GEF) 7
  ENST ID: ENST00000218789
  CDS Start-End: 498-2615
aaaaaagggtgaggagaagcagcggctgagcgggttggcatctggggcagcgggctcgctccaggccgtcgggggccgctcgccagcgtcgcccgctgtgttgggagcgcgggccgtgggcgtcgctcggccttgtccgcggcgtccccgctgccggccacggcgctcagcgcttgtgctctgtattgcaggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtc

SEQ ID NO: 175996 - DNA, 4361 bp, Homo sapiens
  Payload ID: 14554
  Gene Symbol: ARHGEF7
  Gene Name: Rho guanine nucleotide exchange factor (GEF) 7
  Uniprot ID: Q14155
  ENST ID: ENST00000317133
  CDS Start-End: 909-3257
ccccgagacgcagccaggcgcccggcccggcccggcccggccctctgcacagccccacttcaggccacgccgtttccttgaccttcccccggcagggtctgaagcgtcaccgtccgtctagagcagagtcgcgcaggcccctgccctgccggtgaggtcggcgccgcgctccggagagtcggttcctcccgattcagacccatatggcttcagatggaaccatcatttctgttccgtcatgaccggcttgcaaggtagcaaagcgaaacaaacgtctcgttttcagcctgtccccgccaccttgaaataaaaccggcaaaaataaaaagagcattctgggaagtacttcatcatttcaacgctcacgaattcaaaacataaacaaaggcttccgagtgccccggccaggggcgcggggcgcacggcgggcccggggcaggtaagcgcaggtgcgcgcccgcccccacccccggctccctccccatccgctccccgctccccttcccctttcccttccccgcccgctcccagccgccgccgccgccccgcgcacggcctggagcggaggctgcgcagggcgcggggcggcgcgggccgggcgcgggccgggcggacggccgcgtctttcttctcctggcggtgatgtcattgggcgacggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttattt

SEQ ID NO: 175997 - DNA, 4957 bp, Homo sapiens
  Payload ID: 14554
  Gene Symbol: ARHGEF7
  Gene Name: Rho guanine nucleotide exchange factor (GEF) 7
  Uniprot ID: Q14155
  ENST ID: ENST00000375723
  CDS Start-End: 220-2097
acgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgcta

SEQ ID NO: 175998 - DNA, 5032 bp, Homo sapiens
  Payload ID: 14554
  Gene Symbol: ARHGEF7
  Gene Name: Rho guanine nucleotide exchange factor (GEF) 7
  Uniprot ID: Q14155
  ENST ID: ENST00000375736
  CDS Start-End: 474-2414
gctgagcgggttggcatctggggcagcgggctcgctccaggccgtcgggggccgctcgccagcgtcgcccgctgtgttgggagcgcgggccgtgggcgtcgctcggccttgtccgcggcgtccccgctgccggccacggcgctcagcgcttgtgctctgtattgcaggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtc

SEQ ID NO: 175999 - DNA, 5375 bp, Homo sapiens
  Payload ID: 14554
  Gene Symbol: ARHGEF7
  Gene Name: Rho guanine nucleotide exchange factor (GEF) 7
  Uniprot ID: Q14155
  ENST ID: ENST00000375739
  CDS Start-End: 251-2512
gcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaaacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcc

SEQ ID NO: 176000 - DNA, 5525 bp, Homo sapiens
  Payload ID: 14554
  Gene Symbol: ARHGEF7
  Gene Name: Rho guanine nucleotide exchange factor (GEF) 7
  Uniprot ID: Q14155
  ENST ID: ENST00000375741
  CDS Start-End: 251-2662
gcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagctcctgtttcctccttcccagcctcctcagcatctggtaaccaccattctcttgtctgcttctacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcc

SEQ ID NO: 176001 - DNA, 481 bp, Homo sapiens
  Payload ID: 14554
  Gene Symbol: ARHGEF7
  Gene Name: Rho guanine nucleotide exchange factor (GEF) 7
  ENST ID: ENST00000426768
  CDS Start-End: 53-481
acatttttcacatcctgttattctgggttttgtgacttgctgccttgccactatgaagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcggtaag

SEQ ID NO: 176002 - DNA, 4921 bp, Homo sapiens
  Payload ID: 14554
  Gene Symbol: ARHGEF7
  Gene Name: Rho guanine nucleotide exchange factor (GEF) 7
  Uniprot ID: Q14155
  ENST ID: ENST00000426073
  CDS Start-End: 357-2297
gatggtggaaagtgaggagaagcaaaaagacgactacttctttccccatttcccggtctggtctttttggggtctactacgtagaggtgcatcagccagcgctaccatggaggcaggaggcattcttttgctctcgtacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcacagaa

SEQ ID NO: 176003 - DNA, 682 bp, Homo sapiens
  Payload ID: 14554
  Gene Symbol: ARHGEF7
  Gene Name: Rho guanine nucleotide exchange factor (GEF) 7
  ENST ID: ENST00000449979
  CDS Start-End: 484-682
tgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaaacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcg

SEQ ID NO: 176004 - DNA, 1833 bp, Homo sapiens
  Payload ID: 14554
  Gene Symbol: ARHGEF7
  Gene Name: Rho guanine nucleotide exchange factor (GEF) 7
  ENST ID: ENST00000478679
  CDS Start-End: 64-1707
ctgcgtcctctgggttcccagcgttggtgggatggagctgtggcgtccaggctgtgaggtctcatggggtcctgcagcagccagagcgtgcagaagacgaggaggggaagaaaggtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatt

SEQ ID NO: 176005 - DNA, 581 bp, Homo sapiens
  Payload ID: 14554
  Gene Symbol: ARHGEF7
  Gene Name: Rho guanine nucleotide exchange factor (GEF) 7
  ENST ID: ENST00000491775
  CDS Start-End: 463-581
acttccggcgccggggctcacttcctggtgcgggaaggggcagagattggtgcagccccggaggaagaaaaaagggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagtgtcttatgaagggagatccagagaacagaactaagcctcttactgtctgtttactttgattctgtcagcaacttcatgagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaaga

SEQ ID NO: 176006 - DNA, 1681 bp, Homo sapiens
  Payload ID: 14554
  Gene Symbol: ARHGEF7
  Gene Name: Rho guanine nucleotide exchange factor (GEF) 7
  ENST ID: ENST00000466143
  CDS Start-End: 340-1681
gagattggtgcagccccggaggaagaaaaaagggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacc

SEQ ID NO: 176007 - DNA, 1501 bp, Homo sapiens
  Payload ID: 14554
  Gene Symbol: ARHGEF7
  Gene Name: Rho guanine nucleotide exchange factor (GEF) 7
  ENST ID: ENST00000469877
  CDS Start-End: 209-664
gagattggtgcagccccggaggaagaaaaaagggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcaggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtgccagtacttagccgcggagcggaaagcagtgctcatgaaggtggaggcacacccagagactgcatggaggtggaaccgggaagtccggggtctgaggtcctgcctgcagggttgaaaggcatgcctgccagcagacacatttgggagccagagtgtgctgtggtctgaatgtgtttccccagatcatctgttactacagatgatcaccaattggatggtattaaaagcacacgtgcccctgctccgggttgttgctgttgtccttcagaaactctgaggtctggagaggttgcccgaagctcagcagagagtcggaggctgctttttaaacctgatgccacagatgaaaaccctgtacctcacgtattgtgccaatcacccttctgcagtgaatgtcctcacggaacacaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccct

SEQ ID NO: 176008 - DNA, 691 bp, Homo sapiens
  Payload ID: 14554
  Gene Symbol: ARHGEF7
  Gene Name: Rho guanine nucleotide exchange factor (GEF) 7
  ENST ID: ENST00000467053
  CDS Start-End: 508-691
acacttcagatgggggatagtccaggctggtggtggagctcccaggggatttcgcttctgggtagaattgtcatttttttttttcctcagagactgttgtgtgggcctagtggtgcatcaggttccggttagaatccagtgcaggccgcaggcttctctttaattagagagggtcacttcacctccggttagaatccagtgcaggcagcagcttctttttaattagagaggggtctgggtgctgagcttcccatcaggaagaaggggctgtcgtgctgaagtcctgagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcg

SEQ ID NO: 176009 - DNA, 766 bp, Homo sapiens
  Payload ID: 14554
  Gene Symbol: ARHGEF7
  Gene Name: Rho guanine nucleotide exchange factor (GEF) 7
  ENST ID: ENST00000544132
  CDS Start-End: 1-391
ggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccgtaaggacttggtgcttctcctccttccagactccaggcgtggcatcccgtggctgagctgtcagcaagtgatcagttgctttaaaacctaatcaatatttggataaaaagtgcaaaacacttgcttcacatttctctgcagatctttggccctcttcgtgcagtagtgaattgttttccaatgagtgttctcgagaaacaaccctgaattgtgcctcctcacgcacagttcagaggtgcttgggtgggaagctgcttctgctccgtgtggccctagaagactgatttaggggagttttacactcaactatagatgatttttctgagaattttaactgtttattatgcttcatttaagaaaacaaaaaataaatgattatgatgatgaaaagggccagactcatgttgaaggcattaaaagaatttatgaca

SEQ ID NO: 176010 - DNA, 5212 bp, Homo sapiens
  Payload ID: 14555
  Gene Symbol: ARHGEF18
  Gene Name: Rho/Rac guanine nucleotide exchange factor (GEF) 18
  Uniprot ID: Q6ZSZ5
  ENST ID: ENST00000319670
  CDS Start-End: 207-3254
ctcgcgcggcttcccgcttccggctcccagctgctagctactgtggatctgggggggccggacggaggcatcggaggcggctgcgagagtggcagaggagctggcggagagcggcctgcgggcgatcgggccgagcctcgctcaaggagcacccccggggcaccctcctgtccgatggcagcccggccctgtccaggaatgtcggtatgacggtctctcagaaagggggtccccagccaacaccgagcccggctggccctgggacgcaactcggaccaatcacaggagagatggatgaagccgattctgcgtttttaaaatttaagcagacagctgatgactctctgtcccttacatctccaaacaccgagtccatttttgtagaagatccctacaccgcctcgctgaggagtgagattgagtcagacggccacgagtttgaagctgagtcctggagcctcgccgtggatgcagcctacgccaagaagcaaaagagggaggtggtgaaaagacaagatgtcctttatgagctgatgcagacagaggtgcaccacgtgcggacgctcaagatcatgctgaaggtgtactccagggccctgcaggaggagctgcagttcagcagcaaggccattggccgcctcttcccatgcgctgacgacctgctggagacgcacagccacttcctcgctcggctcaaggagcgccgccaggagtccctggaggagggcagtgaccggaattatgtcatccagaaaatcggcgacctcctggttcagcagttttcaggtgaaaatggggagagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgaggcctattccgtggaggggacccatccgagaccctgcagggggagctaattctcaagtcggccatgagcgagatcgagggcatccagagcctgatctgcaggcagctgggcagcgccaacggccaggcggaagacggaggcagctccacaggcccgcccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggcggtaatcgcccaccaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgtgtgagcatgctgccatccggcgtggggccagagtacgcagagcgccccgaggtggctcgccgggacagcgcccccaccgagaaccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccgggcccccagctccctcgccactgccggccacaccactcagcgccaaggaggacgccagcaaagaagacgtcatcttcttctaaaagggccgtgactcaaggaaagtttttaatggaaagttgagccagaactaaaccagggagctgtctgaaatcatagcaccccatccgggtggcggggagatcaactccgagctgtttttccgaggcagtgaggaacggtgccggctctgcacggagctgaggacaggacagaccttgctttgagaaggagctgccggccggggccacgctccacagccgccgcgcgacagtggagccaagggttagggcaccaggaggggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggatgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatg

SEQ ID NO: 176011 - DNA, 5733 bp, Homo sapiens
  Payload ID: 14555
  Gene Symbol: ARHGEF18
  Gene Name: Rho/Rac guanine nucleotide exchange factor (GEF) 18
  Uniprot ID: Q6ZSZ5
  ENST ID: ENST00000359920
  CDS Start-End: 254-3775
aaacaccatgccctgccatctctgggtcttagagtcaccctaacatctgatctagattaattatcatcatgtgcgaggttttggcatgaagcacgccaggctcaccgtttcatgatcttagactatttacagcaaactcaaacagctcacttgctttttacaccctgcaaagaccaagggagagcctggaggggttgttttttttttctgttttattctatcaaagcagcaaatactgcaatttccacagtaaatggtcacagtggggaccaatatcctgccctccagacccgctgcttcagccaatacagcaagggaagacgcagctctgttttctagaaggatcccaccgaggcataaaaacggcgcagcccagcctggcgccgcgccgggtcccggagccccgggcgcgaacatggggaatgcgcactccaaaagcggggacaggcacagcgcgctccccggccgccccgagctgtctttttacggctctttccccaggaaatggagcgagaacgtcttcttggataacgagctgctgacctccaagatcctgtctgtgctgcggccgcagtcggagcggggcttccgcgccggggacctccgctacccgacccactttctcagcaccaactctgtccttgcctctgtcacagcctcgctcaaggagcacccccggggcaccctcctgtccgatggcagcccggccctgtccaggaatgtcggtatgacggtctctcagaaagggggtccccagccaacaccgagcccggctggccctgggacgcaactcggaccaatcacaggagagatggatgaagccgattctgcgtttttaaaatttaagcagacagctgatgactctctgtcccttacatctccaaacaccgagtccatttttgtagaagatccctacaccgcctcgctgaggagtgagattgagtcagacggccacgagtttgaagctgagtcctggagcctcgccgtggatgcagcctacgccaagaagcaaaagagggaggtggtgaaaagacaagatgtcctttatgagctgatgcagacagaggtgcaccacgtgcggacgctcaagatcatgctgaaggtgtactccagggccctgcaggaggagctgcagttcagcagcaaggccattggccgcctcttcccatgcgctgacgacctgctggagacgcacagccacttcctcgctcggctcaaggagcgccgccaggagtccctggaggagggcagtgaccggaattatgtcatccagaaaatcggcgacctcctggttcagcagttttcaggtgaaaatggggagagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgaggcctattccgtggaggggacccatccgagaccctgcagggggagctaattctcaagtcggccatgagcgagatcgagggcatccagagcctgatctgcaggcagctgggcagcgccaacggccaggcggaagacggaggcagctccacaggcccgcccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggcggtaatcgcccaccaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgtgtgagcatgctgccatccggcgtggggccagagtacgcagagcgccccgaggtggctcgccgggacagcgcccccaccgagaaccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccgggcccccagctccctcgccactgccggccacaccactcagcgccaaggaggacgccagcaaagaagacgtcatcttcttctaaaagggccgtgactcaaggaaagtttttaatggaaagttgagccagaactaaaccagggagctgtctgaaatcatagcaccccatccgggtggcggggagatcaactccgagctgtttttccgaggcagtgaggaacggtgccggctctgcacggagctgaggacaggacagaccttgctttgagaaggagctgccggccggggccacgctccacagccgccgcgcgacagtggagccaagggttagggcaccaggaggggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggatgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatg

SEQ ID NO: 176012 - DNA, 4616 bp, Homo sapiens
  Payload ID: 14555
  Gene Symbol: ARHGEF18
  Gene Name: Rho/Rac guanine nucleotide exchange factor (GEF) 18
  ENST ID: ENST00000594665
  CDS Start-End: 1-2437
gagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgaggcctattccgtggaggggacccatccgagaccctgcagggggagctaattctcaagtcggccatgagcgagatcgagggcatccagagcctgatctgcaggcagctgggcagcgccaacggccaggcggaagacggaggcagctccacaggcccgcccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgtgtgagcatgctgccatccggcgtggggccagagtacgcagagcgccccgaggtggctcgccgggacagcgcccccaccgagaaccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccgggcccccagctccctcgccactgccggccacaccactcagcgccaaggaggacgccagcaaagaagacgtcatcttcttctaaaagggccgtgactcaaggtgcaaggcccctccctgccctgcccacccttcctgctctctggggacccccatggggtcaccatgcccacccagctgtcccctcctcttccctagcaaaccactgatgaccgcctggcaggggccagcctgtcggtgctctgggccttgcagctgtttctgtagggttagcggtggtgccggggtcactttctgaatctctttttttttttttcaaaaaggaaagtttttaatggaaagttgagccagaactaaaccagggagctgtctgaaatcatagcaccccatccgggtggcggggagatcaactccgagctgtttttccgaggcagtgaggaacggtgccggctctgcacggagctgaggacaggacagaccttgctttgagaaggagctgccggccggggccacgctccacagccgccgcgcgacagtggagccaagggttagggcaccaggaggggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggatgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatg

SEQ ID NO: 176013 - DNA, 582 bp, Homo sapiens
  Payload ID: 14555
  Gene Symbol: ARHGEF18
  Gene Name: Rho/Rac guanine nucleotide exchange factor (GEF) 18
  ENST ID: ENST00000599752
  CDS Start-End: 323-582
actgtggatctgggggggccggacggaggcatcggaggcggctgcgagagtggcagaggagctggcggagagcggcctgcgggcgatcgggccgaggaaatggagcgagaacgtcttcttggataacgagctgctgacctccaagatcctgtctgtgctgcggccgcagtcggagcggggcttccgcgccggggacctccgctacccgacccactttctcagcaccaactctgtccttgcctctgtcacagcctcgctcaaggagcacccccggggcaccctcctgtccgatggcagcccggccctgtccaggaatgtcggtatgacggtctctcagaaagggggtccccagccaacaccgagcccggctggccctgggacgcaactcggaccaatcacaggagagatggatgaagccgattctgcgtttttaaaatttaagcagacagctgatgactctctgtcccttacatctccaaacaccgagtccatttttgtagaagatccctacaccgcctcgctgaggagtgagattgagtcagacggccacgagtttgaagctgagtcctggagcctcgccgt

SEQ ID NO: 176014 - DNA, 2958 bp, Homo sapiens
  Payload ID: 14556
  Gene Symbol: ARHGEF2
  Gene Name: Rho/Rac guanine nucleotide exchange factor (GEF) 2
  Uniprot ID: Q92974
  ENST ID: ENST00000313667
  CDS Start-End: 1-2958
atgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaa

SEQ ID NO: 176015 - DNA, 4080 bp, Homo sapiens
  Payload ID: 14556
  Gene Symbol: ARHGEF2
  Gene Name: Rho/Rac guanine nucleotide exchange factor (GEF) 2
  Uniprot ID: Q92974
  ENST ID: ENST00000313695
  CDS Start-End: 113-2989
gggatcccgggagggagcggagcggacctgggcttggtcgcctccaagccggcgggaccgagtgctttaggccgcttgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactccataa

SEQ ID NO: 176016 - DNA, 4149 bp, Homo sapiens
  Payload ID: 14556
  Gene Symbol: ARHGEF2
  Gene Name: Rho/Rac guanine nucleotide exchange factor (GEF) 2
  Uniprot ID: Q92974
  ENST ID: ENST00000361247
  CDS Start-End: 101-3061
gagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 176017 - DNA, 1645 bp, Homo sapiens
  Payload ID: 14556
  Gene Symbol: ARHGEF2
  Gene Name: Rho/Rac guanine nucleotide exchange factor (GEF) 2
  ENST ID: ENST00000368315
  CDS Start-End: 1-795
atggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctggga

SEQ ID NO: 176018 - DNA, 420 bp, Homo sapiens
  Payload ID: 14556
  Gene Symbol: ARHGEF2
  Gene Name: Rho/Rac guanine nucleotide exchange factor (GEF) 2
  ENST ID: ENST00000423422
  CDS Start-End: 400-420
cccagcaatcagagcctccaggcccaggaggatgaaaagaacatggagacgagaggctccaaatggagtagccctctgccagctcacatccctctttcaggggctgcagcttggacatcccaagactggccaggttacagcccacaggaggcgaggagtgctcccctttacctcaggaagtccgatgtccgccccagctgtcttctgccccagggaaagcagtgaaggaggagactgcaagcatcgggatgcccaggccccaaggaggccctcttcctgcagatccgagaaggactggacacctttctgggactgcagcaccagggtggctacgcctcccggctggatcaggattcctgtcatccatctgctggccctttggaccactcggccactggcatgctttccaagtctgtaccc

SEQ ID NO: 176019 - DNA, 571 bp, Homo sapiens
  Payload ID: 14556
  Gene Symbol: ARHGEF2
  Gene Name: Rho/Rac guanine nucleotide exchange factor (GEF) 2
  ENST ID: ENST00000495070
  CDS Start-End: 321-571
agtttgggtctgggctgtgcttatgccaacaggaagggctgggctgggggcaagcaacagggctgggctgaggcgaggcagtgttcctccctggtgcccgtcactggccactggatacagacggtagtggtggcgatgtgtgtttcaggaggagactgcaagcatcgggatgcccaggccccaaggaggccctcttcctgcagatccgagaaggactggacacctttctgggactgcagcaccagggtggctacgcctcccggctggatcaggattcctgtcatccatctgctggccctttggaccactcggccactggcatgctttccaagtctgtacccgtgagtggcatcaactgtctcttggaccgttcggatacagatgggaatgtatcccagtcctctgccattgacctcaggaaacgctgcagccagctggaaggacattcaggtacccgggtaggctcctccctgcgacagaccttcagcttcctctcgggcatgaccggaaaggccaagacccgggaaaaggagaagatgaaggaagccaaggatgcccgctataccaatgg

SEQ ID NO: 176020 - DNA, 1877 bp, Homo sapiens
  Payload ID: 14556
  Gene Symbol: ARHGEF2
  Gene Name: Rho/Rac guanine nucleotide exchange factor (GEF) 2
  ENST ID: ENST00000470541
  CDS Start-End: 1-791
cgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgaggtgagaccctggcggagacatggaccagagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactc

SEQ ID NO: 176021 - DNA, 692 bp, Homo sapiens
  Payload ID: 14556
  Gene Symbol: ARHGEF2
  Gene Name: Rho/Rac guanine nucleotide exchange factor (GEF) 2
  ENST ID: ENST00000609707
  CDS Start-End: 158-692
aaagcgctggtgagctggcaccctccgcttcgcctgctctcccctcctctctgcgcatcttccccctagcacagagaagagagtacagcagctcgggggtgagcagagctagggctgggaaggtggagtgaggacgcagagacctagagccagggagatgagtggcaacaggaggcagcccagccgtaggggccagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccg

SEQ ID NO: 176022 - DNA, 764 bp, Homo sapiens
  Payload ID: 14556
  Gene Symbol: ARHGEF2
  Gene Name: Rho/Rac guanine nucleotide exchange factor (GEF) 2
  ENST ID: ENST00000497907
  CDS Start-End: 122-764
gacggtgctgggatcccgggagggagcggagcggacctgggcttggtcgcctccaagccggcgggaccgagtgctttaggccgcttgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatg

SEQ ID NO: 176023 - DNA, 4438 bp, Homo sapiens
  Payload ID: 14556
  Gene Symbol: ARHGEF2
  Gene Name: Rho/Rac guanine nucleotide exchange factor (GEF) 2
  ENST ID: ENST00000462460
  CDS Start-End: 256-3351
acattgtaggggctgctggccatggaagggcactgtctctctgctttgacaatggtccccttgaacaagttcctttagctctggaggagactgcaagcatcgggatgcccaggccccaaggaggccctcttcctgcagatccgagaaggactggacacctttctgggactgcagcaccagggtggctacgcctcccggctggatcaggattcctgtcatccatctgctggccctttggaccactcggccactggcatgctttccaagtctgtacccgtgagtggcatcaactgtctcttggaccgttcggatacagatgggaatgtatcccagtcctctgccattgacctcaggaaacgctgcagccagctggaaggacattcaggtacccgggtaggctcctccctgcgacagaccttcagcttcctctcgggcatgaccggaaaggccaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcc

SEQ ID NO: 176024 - DNA, 892 bp, Homo sapiens
  Payload ID: 14556
  Gene Symbol: ARHGEF2
  Gene Name: Rho/Rac guanine nucleotide exchange factor (GEF) 2
  ENST ID: ENST00000471589
  CDS Start-End: 206-892
gatccagcgtttagttctcctttgatttcctctccctctggccacccctgcccccaatcgtaaaaggggtcagtctgctcaggcctgctttgatgggaccccgaaggccaggaaggaactggtcctgggttttctaagagctgggggcggatggaattctcctgcctgcgggtctttaaagactgagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatc

SEQ ID NO: 176025 - DNA, 372 bp, Homo sapiens
  Payload ID: 14556
  Gene Symbol: ARHGEF2
  Gene Name: Rho/Rac guanine nucleotide exchange factor (GEF) 2
  ENST ID: ENST00000470874
  CDS Start-End: 1-180
caacagaaagcggccctgctgaagaacaacaccgccttgcagtccgtttctcttcgaagtaagaacatttcaatgatgagtctcccctggggctgcgccggatcctctcacagtccacagactccctcaacatgcggaaccgaaccctatccgtggaatccctcattgacgaagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctct

SEQ ID NO: 176026 - DNA, 9484 bp, Homo sapiens
  Payload ID: 14557
  Gene Symbol: ROCK1
  Gene Name: Rho-associated, coiled-coil containing protein kinase 1
  Uniprot ID: Q13464
  ENST ID: ENST00000399799
  CDS Start-End: 942-5006
gctggttccccttccgagcgtccgcgccccgcatgcgcagtctgccccggcggtctccgtttgtttgaacaggaaggcggacatattagtccctctcagcccccctcgccccaccccccaggcattcgccgccgcgactcgccctttccccggctgggaccgcagcccctcccagaagctcccccatcagcagccgccgggacccaactatcgtcttcctcttcgcccgctctccagcctttcctctgctaagtctccatcgggcatcgacctcgccctgccccaccggacaccgtagcagcagccccagcagcgacgggacaaaatgggagagtgaggctgtcctgcgtggaccagctcgtggccgagactgatcggtgcgtcgggccgggccgagtagagccggggacgcggggctagaccgtctacagcgcctctgagcggagcgggcccggcccgtggcccgagcggcggccgcagctggcacagctcctcacccgccctttgctttcgcctttcctcttctccctcccttgttgcccggagggagtctccaccctgcttctctttctctacccgctcctgcccatctcgggacggggacccctccatggcgacggcggccggggcccgctagactgaagcacctcgccggagcgacgaggctggtggcgacggcgctgtcggctgtcgtgaggggctgccgggtgggatgcgactttgggcgtccgagcggctgtgggtcgctgttgcccccggcccggggtctggagagcggaggtcccctcagtgaggggaagacgggggaaccgggcgcacctggtgaccctgaggttccggctcctccgccccgcggctgcgaacccaccgcggaggaagttggttgaaattgctttccgctgctggtgctggtaagagggcattgtcacagcagcagcaacatgtcgactggggacagttttgagactcgatttgaaaaaatggacaacctgctgcgggatcccaaatcggaagtgaattcggattgtttgctggatggattggatgctttggtatatgatttggattttcctgccttaagaaaaaacaaaaatattgacaactttttaagcagatataaagacacaataaataaaatcagagatttacgaatgaaagctgaagattatgaagtagtgaaggtgattggtagaggtgcatttggagaagttcaattggtaaggcataaatccaccaggaaggtatatgctatgaagcttctcagcaaatttgaaatgataaagagatctgattctgcttttttctgggaagaaagggacatcatggcttttgccaacagtccttgggttgttcagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacagagatgtgaagcctgataacatgctgctggataaatctggacatttgaagttagcagattttggtacttgtatgaagatgaataaggaaggcatggtacgatgtgatacagcggttggaacacctgattatatttcccctgaagtattaaaatcccaaggtggtgatggttattatggaagagaatgtgactggtggtcggttggggtatttttatacgaaatgcttgtaggtgatacacctttttatgcagattctttggttggaacttacagtaaaattatgaaccataaaaattcacttacctttcctgatgataatgacatatcaaaagaagcaaaaaaccttatttgtgccttccttactgacagggaagtgaggttagggcgaaatggtgtagaagaaatcaaacgacatctcttcttcaaaaatgaccagtgggcttgggaaacgctccgagacactgtagcaccagttgtacccgatttaagtagtgacattgatactagtaattttgatgacttggaagaagataaaggagaggaagaaacattccctattcctaaagctttcgttggcaatcaactaccttttgtaggatttacatattatagcaatcgtagatacttatcttcagcaaatcctaatgataacagaactagctccaatgcagataaaagcttgcaggaaagtttgcaaaaaacaatctataagctggaagaacagctgcataatgaaatgcagttaaaagatgaaatggagcagaagtgcagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgactgagtgccctgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatgcctgtcagtcgtgatagaacagagttttcctcatatgagtaagaggaagggactttcactttcaagtggaacagccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatgttggacttgatggagaaattaaatatctttcattatgctttacaaaatactgtatatgtttcagcaagtttggggaatgggagaggacaaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtcagtgagtttttcattgataattggtttaatttaaaatatttagaggtttgttggactttcataaattgagtacaatctttgcatcaaactacctgctacaataatgactttataaaactgcaaaaaatgtagaaggttgcaccaacataaaaaggaaatatggcaatacatccatgatgttttccagttaacataggaattaccagataaatactgttaaactcttgtccagtaacaagagttgattcatatggacagtatgatttattgtttatttttttaaccaaatacctcctcagtaatttataatggctttgcagtaatgtgtatcagataagaagcactggaaaaccgatcgtctctaggatgatatgcatgtttcaagtggtattgaaagccgcactgatggatatgtaataataaacatatctgttattaatatactaatgactctgtgctcatttaatgagaaataaaagtaatttatggatgggtatctttaatttttactgcaatgtgttttctcatggctgaaatgaatggaaaacatacttcaaattagtctctgattgtatataaatgtttgtgaaattccatggttagattaaagtgtatttttaaaagataaaacgtggtcttgggctctaaaacaagagtgggaatagttcacatgaaaagctggctaaagtgtgttggaaaacaattctccatgggtctcttgcatttctacacatcagggaagcagaggctctgacaacctttcttttgactatcttttccaaggatatttatgtagtaaacagccttggaagatagagttctcccttgtgaggatgtcgggttcttttactgtccagtataataaagataacgtctcccacctatgatgcaaacccactgtgtgctcagcacccacctgggccactctgcattgcccacatggggcttggagggcaaagggaactgatggaacgtgaaacttatgctgcttttgctgtgctgtgaatgaagtcatctgactctgacccaggggtctcatctcttttgtcaggatccatgaaactgtgactggcagcatgcaaacaggataaaatctcagcacagttcctgacggtgtccttactaccttctcagactcatcaccattacctaatattttaaggtccagttgcagagaacagagttaattctaattagtttaagcaagagaagactttccaaatgacatactaatctgaacttagaattgttgagaactgagagagctttgaggaatcactcccaatgccacattacagaactgggtcaaccaggagagctgcttcctcttctaagttcaggaaaccactcactcccaagtataccaatattgagagggtccagatagtgccataatcaggaatccacactaccactgctggttctctgcaacacttgtcaggcttgctacaatctacctccagttagatgttttgtaccattcctcttgccacttaagaacctcatgtctgcacactgcctcagaaaaggcacttccatgaccctgcttgctggcatttagcacagcctgcatctcacgtctgccttctctaggtgcatctacgtggccaaaattaaatcacatccagacccctagctgcaagaaagtctgagaaatatagcctctagctttctctctaatttgttacaggaggacacactaggagtgtggaatgaaggttcagcattgagttagcccatgcacccacacctgtaagcttctctgagatcaggaactccagctttgggcaacaaagaaaacatagccactgtcattattcacaggttcactcatgacctgtcatttggggtttcagcttaaattaacccattcacccttcatttaaagtaaaaaaaataagtaaaagaacttaaatgacaaactcatagttacttgagtttgtaattcatagttaactttcacagttctataatcaatctggaattcagagtgaggtagagatcaagcagtatttctcccatatggatattcagttgatactgcagtattcattgaaaatacttctttcctgcatcgtaattcaggtgaacaatccattggtgttatttctgtgtccttgccaatatcacacttttaattactgtaactttataataagattttatatctgtagtagaagtccaactttgtaatccctcccaattggcttggctattcttggccttttgcatttccatataattttttatttttgttttgaaacgaagtttcgctcttgttgcccaggctggagtgcagtggcgcgatctcggctcactgcaacctccgcctcccaggttcaagtgatcctcctgcctcagactcccgagtagctgggattacaggtgcccaccaccatgcccagctaatttttgtatttttagtagagacagggtttcaccatgttggccagcctggtcttgaactcctgacctcaggtgatccacacccaccttggcctcccaaagtgctgggattacaggcatgagccaccgcgcctggttgcattcccatataaatttaaaaacaatctactgaaagatgtatacgacctccaccaagaaaattgtaagacatttggagaagtttaaaaagacatgaataaacggaaatggtttttttaaataaacaaatgatttttaaagttgatcattaggttaataaatagtcatataatgacaatccgatgagattatgttgcccagggtggtctctaactcctagcctcaagcagttttactctctcattacaggtgtaggccaccgtgcctggcctgacacttggaaatcttaatcacaattattctttgtttttataatgtttactgttcaaatcaatttctggttggatagtatgtatatataaagccatgctcaatggcctagatatatttactgccaaatcttttatgcttttagtgttttttttctggacaagatctatgcttattgcaataaattaaatgcaaagaatattctagtagaaagtcagtctgcacttcctaaaccccaccccaccccaccaattccttcataactgttattaacagttagctgtgttttctaatggattatctccaaagtatatgtaactcagatttttgtgaggtaggaaaagaataacattaattccacttcacatattgaaagtctaacatacaaagagattaaatatctcctttcttttgccaaatgttaatgaattgtcttatgagaattaagatatgatactttctcccaagctatactgtttcccataaagtatttgagatgttggagattcaagggaaaaaatataaatgcttagaaataaagtgtataatgcaaagattgtgaataaagtgacacttgtatgttaatcctataaattggtttcttgtaccatgtaggatggtttggctattaaattgaattaagtggttca

SEQ ID NO: 176027 - DNA, 584 bp, Homo sapiens
  Payload ID: 14557
  Gene Symbol: ROCK1
  Gene Name: Rho-associated, coiled-coil containing protein kinase 1
  ENST ID: ENST00000578051
  CDS Start-End: 1-300
ccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactaggtaaggatttgaaatgctaacgtttttaacaatgtgaaaatgattggataacagctattaaaatcagaaatctaattgtgcttttcaccacagagggcatcatttttaggtatttgtatgtgaattgcagtgactttataaattagtttaacttattcttgttagagtttaataataataatacatgcaatattatatttatttagttctgtgtctaattttattgtcataagttgctgtacatggcatagttttagcccttaatgctttaaccaacttaattttttt

SEQ ID NO: 176028 - DNA, 5656 bp, Homo sapiens
  Payload ID: 14557
  Gene Symbol: ROCK1
  Gene Name: Rho-associated, coiled-coil containing protein kinase 1
  ENST ID: ENST00000635540
  CDS Start-End: 111-3524
aggttccggctcctccgccccgcggctgcgaacccaccgcggaggaagttggttgaaattgctttccgctgctggtgctggtaagagggcattgtcacagcagcagcaacatgtcgactggggacagttttgagactcgatttgaaaaaatggacaacctgctgcgggatcccaaatcggaagtgaattcggattgtttgctggatggattggatgctttggtatatgatttggattttcctgccttaagaaaaaacaaaaatattgacaactttttaagcagatataaagacacaataaataaaatcagagatttacgaatgaaagctgaagattatgaagtagtgaaggtgattggtagaggtgcatttggagaagttcaattggtaaggcataaatccaccaggaaggtatatgctatgaagcttctcagcaaatttgaaatgataaagagatctgattctgcttttttctgggaagaaagggacatcatggcttttgccaacagtccttgggttgttcagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacagagatgtgaagcctgataacatgctgctggataaatctggacatttgaagttagcagattttggtacttgtatgaagatgaataaggaaggcatggtacgatgtgatacagcggttggaacacctgattatatttcccctgaagtattaaaatcccaaggtggtgatggttattatggaagagaatgtgactggtggtcggttggggtatttttatacgaaatgcttgtaggtgatacacctttttatgcagattctttggttggaacttacagtaaaattatgaaccataaaaattcacttacctttcctgatgataatgacatatcaaaagaagcaaaaaaccttatttgtgccttccttactgacagggaagtgaggttagggcgaaatggtgtagaagaaatcaaacgacatctcttcttcaaaaatgaccagtgggcttgggaaacgctccgagacactgtagcaccagttgtacccgatttaagtagtgacattgatactagtaattttgatgacttggaagaagataaaggagaggaagaaacattccctattcctaaagctttcgttggcaatcaactaccttttgtaggatttacatattatagcaatcgtagatacttatcttcagcaaatcctaatgataacagaactagctccaatgcagataaaagcttgcaggaaagtttgcaaaaaacaatctataagctggaagaacagctgcataatgaaatgcagttaaaagatgaaatggagcagaagtgcagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagttgattctgcctgcattccttatttatttatcttctattcttgtcttctagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgactgagtgccctgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatgcctgtcagtcgtgatagaacagagttttcctcatatgagtaagaggaagggactttcactttcaagtggaacagccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatgttggacttgatggagaaattaaatatctttcattatgctttacaaaatactgtatatgtttcagcaagtttggggaatgggagaggacaaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtcagtgagtttttcattgataattggtttaatttaaaatatttagaggtttgttggactttcataaattgagtacaatctttgcatcaaactacctgctacaataatgactttataaaactgcaaaaaatgtagaaggttgcaccaacataaaaaggaaatatggcaatacatccatgatgttttccagttaacataggaattaccagataaatactgttaaactcttgtccagtaacaagagttgattcatatggacagtatgatttattgtttatttttttaaccaaatacctcctcagtaatttataatggctttgcagtaatgtgtatcagataagaagcactggaaaaccgatcgtctctaggatgatatgcatgtttcaagtggtattgaaagccgcactgatggatatgtaat

SEQ ID NO: 176029 - DNA, 1795 bp, Homo sapiens
  Payload ID: 14558
  Gene Symbol: ROCK2
  Gene Name: Rho-associated, coiled-coil containing protein kinase 2
  ENST ID: ENST00000261535
  CDS Start-End: 6-1346
gcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaactgattccatacaatcaaggaaaaatgaagaaagtcaagaggtatgttgatgttgtcagatatattgaaaaactgagaaaagctcatcactctcgcaaagtttaaatatagtcatatcctacctagcatttggagtactacatctacccaagagagaagttcccaacctttcttctaccaaattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactct

SEQ ID NO: 176030 - DNA, 8292 bp, Homo sapiens
  Payload ID: 14558
  Gene Symbol: ROCK2
  Gene Name: Rho-associated, coiled-coil containing protein kinase 2
  Uniprot ID: O75116
  ENST ID: ENST00000315872
  CDS Start-End: 450-4616
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaactgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacaatgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagttttttttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctcaaaaaaaaaaaaaaaaaaaagtcatctaatatttcgatgaaggaaatagacatttttcattgattccctctgatgtcagttagagatatttaaaaagttagatccccataatagatactattgtggaaactgaagagtagctactggcctactgatagactgaaactggttttgttattcttaacgttctccagtctgcactctgctgtgctgtctgtgctcagactagacgtgcatgccgtttcctttgcaggtgtgttctgcagctctggttttgggggatagctcttttttaagtaagattaaaaaatgaaaaatatataaatttatatagaataaatatttccattcattagagttgttaaaaggagactgaattaatattttatataaagattttgttacattatgggaggttctatcctattctgaattggagagtatatatatatatatatatatatatatatttttaataaactttattaaggtgaaataatttcaagtttacatatgagtaactgaaatatttgagtaaaaaaggcaaaagtttaaatttggaatgctgtatatattagagaatatggggaatcatggtgtgaccaactgtacaaggaagattcatatgaaggtcttaggggaaaaagataattctgaagggtgaaaaaaaaatctctcccatggagattcttcacattatatggtttgacataagggtttataaggttgtttgtccaactaatgaaaatgcgcttaataaaaaattctgaccttgggtaagaattcgctttttaccgcattgccgctttcatgtacatacatgagtgcatgcacctatcaatgtgttttcttcccaacacttattaaatataaaacaacctgattttgtgctcgtttctcgtttttcttgaggccctgaagcttccaagataaatataagactaaaatttgcttgttccttcacacctgatttctcctagaaccataaatacctcctatggggaactaagaaatcatgaatactgggattttcttattggattttttacttttgttttgtggggataacgagacagaagtgaaaggaaaactggtgccggtattactgttgaaattaatgtacagtgaatgtttttaaagtattaattttaaaaaaccatgttctctagaaacaagttttaaaaatctatatgaaagttttaaaatgttccagctaactaatggataagcataccagtaaagccaaagtaaaggttagtgcctttaaaactaacctgtgttagagttacatgaatctggctctaaagtatctattttgcatccatttatatatagatcttaaacagaaatactctaggttgccacaccacagttttaagaagttatgctgctgctgttactctcttctaggattctggtggtaaagtagagaaactcggacactatattaaccttactgaaacatgctttaaatcgtgtctaaaatctgatttgagcaagtcactgccgagcttctgagtctgcattgacactgctactgactcacctctccttccctggaataaggcttcagcttccctatgctgtgaagacaccatttgtaagcactttgaacataagcactgtgtgacagcgctggatatcatgcttgggggggggcctctccctgactcccatccccataataatgagttttgtttggaattgtaataagtaatgaactgcatggtttagaaaattataaatatttgatcagctgtcctctctgaaaaaaattgcacccctttttcttttttaaaattttgttgcatcttcgtagtaatgtaattgtattttatgcctgcttttttataaaaaaataaaataaaataaatggagacataagcatttt

SEQ ID NO: 176031 - DNA, 4017 bp, Homo sapiens
  Payload ID: 14558
  Gene Symbol: ROCK2
  Gene Name: Rho-associated, coiled-coil containing protein kinase 2
  ENST ID: ENST00000401753
  CDS Start-End: 474-3911
atgggccatttttgtctatcttaatctatccagctagaacttaatatccctatatatttttggtctttttgatagagtctgttatattctgcaacccttaatcaatgtttaataggtggagttttttattgtacccaaagctccctcttgtggtatttggtataatatagtgtgaaatgattaacagtgcaaattatctttaatgaaaatgaagtatgaaataatttcctaatagaatgctaaacttatgtctgctatacataagagaagatgtttttgtgttgtacttccatgaatgtattgcgattttcattaaaccaaaaacttttggcactagggtacagacaaataaatcataccacatatttttagggaagataagggtggttaaggagagcaaggtgtagagaagaagaatatggggaacgggatagaatatggtacctacagaataattgtataagcatacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaactgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctg

SEQ ID NO: 176032 - DNA, 729 bp, Homo sapiens
  Payload ID: 14558
  Gene Symbol: ROCK2
  Gene Name: Rho-associated, coiled-coil containing protein kinase 2
  ENST ID: ENST00000431087
  CDS Start-End: 119-729
ggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcag

SEQ ID NO: 176033 - DNA, 6401 bp, Homo sapiens
  Payload ID: 14558
  Gene Symbol: ROCK2
  Gene Name: Rho-associated, coiled-coil containing protein kinase 2
  ENST ID: ENST00000616279
  CDS Start-End: 2505-4616
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaactgattccatacaatcaaggaaaaatgaagtacgtatacagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacaatgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagttttttttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctc

SEQ ID NO: 176034 - DNA, 2592 bp, Homo sapiens
  Payload ID: 14559
  Gene Symbol: RHO
  Gene Name: rhodopsin
  Uniprot ID: P08100
  ENST ID: ENST00000296271
  CDS Start-End: 95-1141
gagtcatccagctggagccctgagtggctgagctcaggccttcgcagcattcttgggtgggagcagccacgggtcagccacaagggccacagccatgaatggcacagaaggccctaacttctacgtgcccttctccaatgcgacgggtgtggtacgcagccccttcgagtacccacagtactacctggctgagccatggcagttctccatgctggccgcctacatgtttctgctgatcgtgctgggcttccccatcaacttcctcacgctctacgtcaccgtccagcacaagaagctgcgcacgcctctcaactacatcctgctcaacctagccgtggctgacctcttcatggtcctaggtggcttcaccagcaccctctacacctctctgcatggatacttcgtcttcgggcccacaggatgcaatttggagggcttctttgccaccctgggcggtgaaattgccctgtggtccttggtggtcctggccatcgagcggtacgtggtggtgtgtaagcccatgagcaacttccgcttcggggagaaccatgccatcatgggcgttgccttcacctgggtcatggcgctggcctgcgccgcacccccactcgccggctggtccaggtacatccccgagggcctgcagtgctcgtgtggaatcgactactacacgctcaagccggaggtcaacaacgagtcttttgtcatctacatgttcgtggtccacttcaccatccccatgattatcatctttttctgctatgggcagctcgtcttcaccgtcaaggaggccgctgcccagcagcaggagtcagccaccacacagaaggcagagaaggaggtcacccgcatggtcatcatcatggtcatcgctttcctgatctgctgggtgccctacgccagcgtggcattctacatcttcacccaccagggctccaacttcggtcccatcttcatgaccatcccagcgttctttgccaagagcgccgccatctacaaccctgtcatctatatcatgatgaacaagcagttccggaactgcatgctcaccaccatctgctgcggcaagaacccactgggtgacgatgaggcctctgctaccgtgtccaagacggagacgagccaggtggccccggcctaagacctgcctaggactctgtggccgactataggcgtctcccatcccctacaccttcccccagccacagccatcccaccaggagcagcgcctgtgcagaatgaacgaagtcacataggctccttaattttttttttttttttaagaaataattaatgaggctcctcactcacctgggacagcctgagaagggacatccaccaagacctactgatctggagtcccacgttccccaaggccagcgggatgtgtgcccctcctcctcccaactcatctttcaggaacacgaggattcttgctttctggaaaagtgtcccagcttagggataagtgtctagcacagaatggggcacacagtaggtgcttaataaatgctggatggatgcaggaaggaatggaggaatgaatgggaagggagaacatatctatcctctcagaccctcgcagcagcagcaactcatacttggctaatgatatggagcagttgtttttccctccctgggcctcactttcttctcctataaaatggaaatcccagatccctggtcctgccgacacgcagctactgagaagaccaaaagaggtgtgtgtgtgtctatgtgtgtgtttcagcactttgtaaatagcaagaagctgtacagattctagttaatgttgtgaataacatcaattaatgtaactagttaattactatgattatcacctcctgatagtgaacattttgagattgggcattcagatgatggggtttcacccaaccttggggcaggtttttaaaaattagctaggcatcaaggccagaccagggctgggggttgggctgtaggcagggacagtcacaggaatgcagaatgcagtcatcagacctgaaaaaacaacactgggggagggggacggtgaaggccaagttcccaatgagggtgagattgggcctggggtctcacccctagtgtggggccccaggtcccgtgcctccccttcccaatgtggcctatggagagacaggcctttctctcagcctctggaagccacctgctcttttgctctagcacctgggtcccagcatctagagcatggagcctctagaagccatgctcacccgcccacatttaattaacagctgagtccctgatgtcatccttatctcgaagagcttagaaacaaagagtgggaaattccactgggcctaccttccttggggatgttcatgggccccagtttccagtttcccttgccagacaagcccatcttcagcagttgctagtccattctccattctggagaatctgctccaaaaagctggccacatctctgaggtgtcagaattaagctgcctcagtaactgctcccccttctccatataagcaaagccagaagctctagctttacccagctctgcctggagactaaggcaaattgggccattaaaagctcagctcctatgttggtattaa

SEQ ID NO: 176035 - DNA, 2992 bp, Homo sapiens
  Payload ID: 14560
  Gene Symbol: RHBDF1
  Gene Name: rhomboid 5 homolog 1 (Drosophila)
  Uniprot ID: Q96CC6
  ENST ID: ENST00000262316
  CDS Start-End: 144-2711
gcattcccgggcgggccggaccggcgggcgggcggggactcggcgcgggccctcccggccagcggcggcagcctcctccccggcgccctcaggaccccccagagcccccggcggcggcagcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcaccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcgtccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaagtggccgatctgcaccaaaaacagcgctgggaaccacaccaaccatccccacatggactgtgtcatcacaggacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgaggtgcctgaccagttctaccgcctgtggctatccctcttcctgcacgccgggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcagggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttga

SEQ ID NO: 176036 - DNA, 435 bp, Homo sapiens
  Payload ID: 14560
  Gene Symbol: RHBDF1
  Gene Name: rhomboid 5 homolog 1 (Drosophila)
  ENST ID: ENST00000419764
  CDS Start-End: 25-435
gcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagccgacaagtacgcttcgggcgtgtccacactctgcccctcttgggtccccgggctgcccgcagggccttcccacagcgccagtctctctcttggtccctgctcagggggaccgccgactggtttggagtgagcaaggacagtgacagcacccagaaatggcag

SEQ ID NO: 176037 - DNA, 901 bp, Homo sapiens
  Payload ID: 14560
  Gene Symbol: RHBDF1
  Gene Name: rhomboid 5 homolog 1 (Drosophila)
  ENST ID: ENST00000448893
  CDS Start-End: 1-698
gacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcagggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataa

SEQ ID NO: 176038 - DNA, 615 bp, Homo sapiens
  Payload ID: 14560
  Gene Symbol: RHBDF1
  Gene Name: rhomboid 5 homolog 1 (Drosophila)
  ENST ID: ENST00000450643
  CDS Start-End: 128-615
ctcatgctcccaccacaggctggaagcggtgggatgagagttccaactgtggcctgcagagtgggctggcgggctggtccaggacaagagaaagtggtgccaggcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccg

SEQ ID NO: 176039 - DNA, 2751 bp, Homo sapiens
  Payload ID: 14560
  Gene Symbol: RHBDF1
  Gene Name: rhomboid 5 homolog 1 (Drosophila)
  ENST ID: ENST00000428730
  CDS Start-End: 25-591
gcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcaccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcgtccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaagtggccgatctgcaccaaaaacagcgctgggaaccacaccaaccatccccacatggactgtgtcatcacaggacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgaggtgcctgaccagttctaccgcctgtggctatccctcttcctgcacgccgggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcagggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaact

SEQ ID NO: 176040 - DNA, 816 bp, Homo sapiens
  Payload ID: 14560
  Gene Symbol: RHBDF1
  Gene Name: rhomboid 5 homolog 1 (Drosophila)
  ENST ID: ENST00000417043
  CDS Start-End: 23-289
ctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagaccctggtccctggagtgactacaggcctgggggcagcatgctgccccggaggagggcctttgaagtcccctgcctgggaggggcgatctggccgccccttgctgagtccctgccatgccagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaa

SEQ ID NO: 176041 - DNA, 3582 bp, Homo sapiens
  Payload ID: 14561
  Gene Symbol: RHBDF2
  Gene Name: rhomboid 5 homolog 2 (Drosophila)
  Uniprot ID: Q6PJF5
  ENST ID: ENST00000313080
  CDS Start-End: 275-2845
gccgctcgcaggcgccgcacggagttgcgtcccggggacttggggccgcagggagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagggttttcagaataggaggctaaagaaaagccagcccaggacctgggctgcacacaccaccgcctgccctccctccttcctccccaagaggaagaacccagcctacttgaagagcgtcagcctccaggagccacgcagccgatggcaggagagttcagagaagcgccctggcttccgccgccaggcctcactgtcccagagcatccgcaagggcgcagcccagtggtttggagtcagcggcgactgggaggggcagcggcagcagtggcagcgccgcagcctgcaccactgcagcatgcgctacggccgcctgaaggcctcgtgccagcgtgacctggagctccccagccaggaggcaccgtccttccagggcactgagtccccaaagccctgcaagatgcccaagattgtggatccgctggcccggggccgggccttccgccacccggaggagatggacaggccccacgccccgcacccaccgctgacccccggagtcctgtccctcacctccttcaccagtgtccgttctggctactcccacctgccacgccgcaagagaatgtctgtggcccacatgagcttgcaagctgccgctgccctcctcaaggggcgctcggtgctggatgccaccggacagcggtgccgggtggtcaagcgcagctttgccttcccgagcttcctggaggaggatgtggtcgatggggcagacacgtttgactcctccttttttagtaaggaagaaatgagctccatgcctgatgatgtctttgagtcccccccactctctgccagctacttccgagggatcccacactcagcctcccctgtctcccccgatggggtgcaaatccctctgaaggagtatggccgagccccagtccccgggccccggcgcggcaagcgcatcgcctccaaggtgaagcactttgcctttgatcggaagaagcggcactacggcctcggcgtggtgggcaactggctgaaccgcagctaccgccgcagcatcagcagcactgtgcagcggcagctggagagcttcgacagccaccggccctacttcacctactggctgaccttcgtccatgtcatcatcacgctgctggtgatttgcacgtatggcatcgcacccgtgggctttgcccagcacgtcaccacccagctggtgctgcggaacaaaggtgtgtacgagagcgtgaagtacatccagcaggagaacttctgggttggccccagctcgattgacctgatccacctgggggccaagttctcaccctgcatccggaaggacgggcagatcgagcagctggtgctgcgcgagcgagacctggagcgggactcaggctgctgtgtccagaatgaccactccggatgcatccagacccagcggaaggactgctcggagactttggccacttttgtcaagtggcaggatgacactgggccccccatggacaagtctgatctgggccagaagcggacttcgggggctgtctgccaccaggaccccaggacctgcgaggagccagcctccagcggtgcccacatctggcccgatgacatcactaagtggccgatctgcacagagcaggccaggagcaaccacacaggcttcctgcacatggactgcgagatcaagggccgcccctgctgcatcggcaccaagggcagctgtgagatcaccacccgggaatactgtgagttcatgcacggctatttccatgaggaagcaacactctgctcccaggtgcactgcttggacaaggtgtgtgggctgctgcccttcctcaaccctgaggtcccagatcagttctacaggctctggctgtctctcttcctacatgctggcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctgagaccatctcctggggcagggtccttttcttcccaggtcctcagcgctgcctctgctggtgccttctcccccactactactggagcgtgcccttgctggggacgtggctgtgccctcagttgcccccagggctgggtgcccaccatgccccttcctctttctcctcctacctctgccctgtgagcccatccataaggctctcagatgggacattgtgggaaaggctttggccatggtctgggggcagagaacaaggggggagacacaagtagacctcaggtagaacgacactgggcggagccaccccagggcctgctcccagggagtgctcgaggcgcatcaggcccgttttttaccagtttatatcacggtcttcatttttaaaagtaacgctaactttgtacggacgatgtctcatggattaaataatattctttatggca

SEQ ID NO: 176042 - DNA, 613 bp, Homo sapiens
  Payload ID: 14561
  Gene Symbol: RHBDF2
  Gene Name: rhomboid 5 homolog 2 (Drosophila)
  ENST ID: ENST00000591697
  CDS Start-End: 392-613
gaggagccaccgcccagccgctcgcaggcgccgcacggagttgcgtcccggggacttggggccgcagggaggttcccagaccagaggactgttgttaggtgattggctgtgaacaccctgaggccagtgcccctcgctgcttggcactcggagatgcctgattagcacctttaatcccttaccagtgaggcaggtggaattggccccattttacagatggggagactgagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagaggaagaacccagcctacttgaagagcgtcagcctccaggagccacgcagccgatggcaggagagttcagag

SEQ ID NO: 176043 - DNA, 574 bp, Homo sapiens
  Payload ID: 14561
  Gene Symbol: RHBDF2
  Gene Name: rhomboid 5 homolog 2 (Drosophila)
  ENST ID: ENST00000590322
  CDS Start-End: 489-574
aaaaataacaggggccatcttgactctaatgttctgctccaatcaggttcccagaccagaggactgttgttaggtgattggctgtgaacaccctgaggccagtgcccctcgctgcttggcactcggagatgcctgattagcacctttaatcccttaccagtgaggcaggtggaattggccccattttacagatggggagactgaggtgaggaaggttaaagcactcagtggtgggcatgccccctggagccggccctcctttcttccagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccat

SEQ ID NO: 176044 - DNA, 545 bp, Homo sapiens
  Payload ID: 14561
  Gene Symbol: RHBDF2
  Gene Name: rhomboid 5 homolog 2 (Drosophila)
  ENST ID: ENST00000591255
  CDS Start-End: 506-545
accgcccagccgctcgcaggcgccgcacggagttgcgtcccggggacttggggccgcagggaggttcccagaccagaggactgttgttaggtgattggctgtgaacaccctgaggccagtgcccctcgctgcttggcactcggagatgcctgattagcacctttaatcccttaccagtgaggcaggtggaattggccccattttacagatggggagactgaggtgaggaaggttaaagcactcagtggtgggcatgccccctggagccggccctcctttcttccagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctg

SEQ ID NO: 176045 - DNA, 589 bp, Homo sapiens
  Payload ID: 14561
  Gene Symbol: RHBDF2
  Gene Name: rhomboid 5 homolog 2 (Drosophila)
  ENST ID: ENST00000591879
  CDS Start-End: 371-589
actataaccgctgcctcctgggttcaagccatcctgcctcagcctcccgagtagctgggattacaggcacgtgccaccacgcctagctaattttttgtatttttagtagagacggggtttcaccatgttggccaggatggtctcgatctcctgacctcgtgatccccccacctcggcctcccaaagtgctgggattacaggcgtgagccaccgcgcccagccgcccagagatgtttgaaccaactttaggcaagttggttcttggtctgggctgcgtgccctggcgtcagggtcctgacactgcgccaccccgcaccgcccaccgctgctctcccggtctccattccagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagaggaagaacccagcctacttgaagagcgtcagcctccaggagccacgcagccgatggcaggagagttca

SEQ ID NO: 176046 - DNA, 568 bp, Homo sapiens
  Payload ID: 14561
  Gene Symbol: RHBDF2
  Gene Name: rhomboid 5 homolog 2 (Drosophila)
  ENST ID: ENST00000585989
  CDS Start-End: 231-568
ggagccaccgcccagccgctcgcaggcgccgcacggagttgcgtcccggggacttggggccgcagggagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagaggaagaacccagcctacttgaagagcgtcagcctccaggagccacgcagccgatggcaggagagttcagagaagcgccctggcttccgccgccaggcctcactgtcccagagcatccgcaagggcgcagcccagtggtttggagtcagcggcgactgggaggggcagcggcagcagtggcagcgccg

SEQ ID NO: 176047 - DNA, 734 bp, Homo sapiens
  Payload ID: 14561
  Gene Symbol: RHBDF2
  Gene Name: rhomboid 5 homolog 2 (Drosophila)
  ENST ID: ENST00000590288
  CDS Start-End: 656-734
gacttggggccgcagggaggtgagcgcggggcgacgagcggggcaggactcacggccgcccagccgcaggcgccggaagggtcccgaggttgtgcccgagcctgccctggagcggtggtgcgcggccaggaagggtgcccagtgcccggtgcccgccctgcggagcgcctgggtcccacgtgggctcggctggaggcccgggctggctcagacggcgccggcggggccgctggacccggtctgctggcccctagggctcggctcggacaggacgcctaaggggtccctgggcgacggggcgccagatgtaggggcaagacgattgggcagagatttaaacctccggaggaagagaggagactgcgcagggcagtcccgcctgcgtcccagaagtgcctgcagttcagacccttctctcccctccactttctcccggctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacc

SEQ ID NO: 176048 - DNA, 572 bp, Homo sapiens
  Payload ID: 14561
  Gene Symbol: RHBDF2
  Gene Name: rhomboid 5 homolog 2 (Drosophila)
  ENST ID: ENST00000585701
  CDS Start-End: 431-572
accctagcatcctgtgattcagccgcgaagacgtggccccaagcctcccaccgccctccttctgtcctgactgcccactcccagggacaccaggttcccagaccagaggactgttgttaggtgattggctgtgaacaccctgaggccagtgcccctcgctgcttggcactcggagatgcctgattagcacctttaatcccttaccagtgagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgc

SEQ ID NO: 176049 - DNA, 3599 bp, Homo sapiens
  Payload ID: 14561
  Gene Symbol: RHBDF2
  Gene Name: rhomboid 5 homolog 2 (Drosophila)
  Uniprot ID: Q6PJF5
  ENST ID: ENST00000591885
  CDS Start-End: 552-3035
acttggcctgaggatgagggcgctggaagaaggggatgggagattgggtgctttttcttgatggggaggggcgacttgaagacggcaatcaagacctagatgacgtgtttggtctggggtggagtgaggacgccaagagggaaaggacggcgccctgaagagaccagctcaggcgaaaacagggctctgcccaggcggggacccagctgggtggagggcggaggcaggaacccaggaagccgactgagcaaagactgcgtccaggccccgcccccatgagcccggccacgccccctggagcccagccccgcctcccggccgcccgcgcgcagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagaggaagaacccagcctacttgaagagcgtcagcctccaggagccacgcagccgatggcaggagagttcagagaagcgccctggcttccgccgccaggcctcactgtcccagagcatccgcaagggcgcagcccagtggtttggagtcagcggcgactgggaggggcagcggcagcagtggcagcgccgcagcctgcaccactgcagcatgcgctacggccgcctgaaggcctcgtgccagcgtgacctggagctccccagccaggaggcaccgtccttccagggcactgagtccccaaagccctgcaagatgcccaagattgtggatccgctggcccggggccgggccttccgccacccggaggagatggacaggccccacgccccgcacccaccgctgacccccggagtcctgtccctcacctccttcaccagtgtccgttctggctactcccacctgccacgccgcaagagaatgtctgtggcccacatgagcttgcaagctgccgctgccctcctcaaggggcgctcggtgctggatgccaccggacagcggtgccgggtggtcaagcgcagctttgccttcccgagcttcctggaggaggatgtggtcgatggggcagacacgtttgactcctccttttttagtaaggaagaaatgagctccatgcctgatgatgtctttgagtcccccccactctctgccagctacttccgagggatcccacactcagcctcccctgtctcccccgatggggtgcaaatccctctgaaggagtatggccgagccccagtccccgggccccggcgcggcaagcgcatcgcctccaaggtgaagcactttgcctttgatcggaagaagcggcactacggcctcggcgtggtgggcaactggctgaaccgcagctaccgccgcagcatcagcagcactgtgcagcggcagctggagagcttcgacagccaccggccctacttcacctactggctgaccttcgtccatgtcatcatcacgctgctggtgatttgcacgtatggcatcgcacccgtgggctttgcccagcacgtcaccacccagctggtgctgcggaacaaaggtgtgtacgagagcgtgaagtacatccagcaggagaacttctgggttggccccagctcgattgacctgatccacctgggggccaagttctcaccctgcatccggaaggacgggcagatcgagcagctggtgctgcgcgagcgagacctggagcgggactcaggctgctgtgtccagaatgaccactccggatgcatccagacccagcggaaggactgctcggagactttggccacttttgtcaagtggcaggatgacactgggccccccatggacaagtctgatctgggccagaagcggacttcgggggctgtctgccaccaggaccccaggacctgcgaggagccagcctccagcggtgcccacatctggcccgatgacatcactaagtggccgatctgcacagagcaggccaggagcaaccacacaggcttcctgcacatggactgcgagatcaagggccgcccctgctgcatcggcaccaagggcagctgtgagatcaccacccgggaatactgtgagttcatgcacggctatttccatgaggaagcaacactctgctcccaggtgcactgcttggacaaggtgtgtgggctgctgcccttcctcaaccctgaggtcccagatcagttctacaggctctggctgtctctcttcctacatgctggcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctgagaccatctcctggggcagggtccttttcttcccaggtcctcagcgctgcctctgctggtgccttctcccccactactactggagcgtgcccttgctggggacgtggctgtgccctcagttgcccccagggctgggtgcccaccatgccccttcctctttctcctcctacctctgccctgtgagcccatccataaggctctcagatgggacattgtgggaaaggctttggccatggtctgggggcagagaacaaggggggagacacaagt

SEQ ID NO: 176050 - DNA, 582 bp, Homo sapiens
  Payload ID: 14561
  Gene Symbol: RHBDF2
  Gene Name: rhomboid 5 homolog 2 (Drosophila)
  ENST ID: ENST00000591860
  CDS Start-End: 1-261
ctgcccttcctcaaccctgaggtcccagatcagttctacaggctctggctgtctctcttcctacatgctggcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagagcctcaggggtccccatgcctgccagggaggagctgatcgatgggatgacccagggtgcaggcccggcccaggccacccacctgatgcctgaagccacgtctcccctgccccgccccaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcga

SEQ ID NO: 176051 - DNA, 935 bp, Homo sapiens
  Payload ID: 14561
  Gene Symbol: RHBDF2
  Gene Name: rhomboid 5 homolog 2 (Drosophila)
  ENST ID: ENST00000592123
  CDS Start-End: 381-935
gcccagccgctcgcaggcgccgcacggagttgcgtcccggggacttggggccgcagggaggttcccagaccagaggactgttgttaggtgattggctgtgaacaccctgaggccagtgcccctcgctgcttggcactcggagatgcctgattagcacctttaatcccttaccagtgaggcaggtggaattggccccattttacagatggggagactgagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagggttttcagaataggaggctaaagaaaagccagcccaggacctgggctgcacacaccaccgcctgccctccctccttcctccccaagaggaagaacccagcctacttgaagagcgtcagcctccaggagccacgcagccgatggcaggagagttcagagaagcgccctggcttccgccgccaggcctcactgtcccagagcatccgcaagggcgcagcccagtggtttggagtcagcggcgactgggaggggcagcggcagcagtggcagcgccgcagcctgcaccactgcagcatgcgctacggccgcctgaaggcctcgtgccagcgtgacctggagctccccagccaggaggcaccgtccttccagggcactgagtccccaaagccctgcaagatgcccaag

SEQ ID NO: 176052 - DNA, 629 bp, Homo sapiens
  Payload ID: 14561
  Gene Symbol: RHBDF2
  Gene Name: rhomboid 5 homolog 2 (Drosophila)
  ENST ID: ENST00000589526
  CDS Start-End: 361-629
gtggcaagggagctggggagagaagcagtttccttgtccccagccctcaccctagcatcctgtgattcagccgcgaagacgtggccccaagcctcccaccgccctccttctgtcctgactgcccactcccagggacaccagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagaggaagaacccagcctacttgaagagcgtcagcctccaggagccacgcagccgatggcaggagagttcagagaagcgccctggcttccgccgccaggcctcactgtcccagagcatccg

SEQ ID NO: 176053 - DNA, 554 bp, Homo sapiens
  Payload ID: 14561
  Gene Symbol: RHBDF2
  Gene Name: rhomboid 5 homolog 2 (Drosophila)
  ENST ID: ENST00000591192
  CDS Start-End: 414-554
accctagcatcctgtgattcagccgcgaagacgtggccccaagcctcccaccgccctccttctgtcctgactgcccactcccagggacaccaggttcccagaccagaggactgttgttaggtgattggctgtgaacaccctgaggccagtgcccctcgctgcttggcactcggagatgcctgattagcacctttaatcccttaccagtgaggcaggtggaattggccccattttacagatggggagactgagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatg

SEQ ID NO: 176054 - DNA, 4883 bp, Homo sapiens
  Payload ID: 14562
  Gene Symbol: RHBDD1
  Gene Name: rhomboid domain containing 1
  Uniprot ID: Q8TEB9
  ENST ID: ENST00000341329
  CDS Start-End: 243-1190
acaactaagcatgcgccgcggccgagccgtccgctttaaggccctcccctcccgcacccggccccaggaacccggggcgccccggatcgggaacgtgcgtgatgacgcacgtgcgcgcgaagacgtggggacgcaggcgggtcgtagagagcgttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggagttttgtttgctttgaaagttcttaacaaccattattgccctggaggctttgtcaacattttgggctttcctgtaccgaacagatttgcttgttgggtcgaacttgtggctattcatttattctcaccagggacttccttcgctgggcatctggctgggattcttgttggactaatgtacactcaagggcctctgaagaaaatcatggaagcatgtgcaggcggtttttcctccagtgttggttacccaggacggcaatactactttaatagttcaggcagctctggatatcaggattattatccgcatggcaggccagatcactatgaagaagcacccaggaactatgacacgtacacagcaggactgagtgaagaagaacagctcgagagagcattacaagccagcctctgggaccgaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggcccctatgagtcaactcacagcttgcggggagtgggccttctcctggccttgttcttgctcataaacaggtcacttcctccatgaagagaccagtttccacgctcccatctctcactgctgactcagcgatgcctctgcctcggtctgcttttgaagactgtgaccttcaccaggaggttttacttacaccagtcgggaagattagtccctcattctgcctggagtgccccgtgtttgacttggcagcgggtgtggagccatccccgcgtcctcctggcgcattgccactgtggctgtccaggaacaggatgtggctgccttggccgaatgttgtcctactctccccaaccccggcgcctcagctcctcagctcctcgggcccctgcgtctggctggtgtttgcagggctttcgctctgctctggtattgctctgcctttatagaaagtcttattgaagaagtgtaagaaagacctaaggtggggaagactcctacacacaccattagtatcagtgacaccagcaatgtaggttcccagccccttcccagtggcagcttgtgtgtccaggagataggacatcatttaacgcatcagcaaagtagcagcagatgccacatacagagtagagcgaaggcatttggtggatcggtcactagagatctatcttgcagaaagtatgtttttcctcataaaagtgcctcttaattggccattgtaccagccacttgtcctagccaaatgtccaaaacacgcccttgggccccgccacgttacaatccacagattgtctgtctgagtcgtttaaggcatttcctggtgcttgtgttccatgaataaaaggacaaagtcagaagatcactgatgtcttactgtcaacagagatattttaaaagagagaagcaggaaaagatcttccttttttgatctacaacttatatagttttctgattatgcacataatagatatgccttccagatgcataaggcaaacatctggaaagaaatatacccaaatcttagcaggggttatctttgggagtggagtacatgggattttgctttcttcatttttataattttatattactgtcttggaagatgtgtttatgtgtgtgtgttacttttacaatcaggaaaacatatttaataacatatagtcaagaaaacagacttaaaaataaatactatgtgtccattgagaaaattcacaatataaacagaaatacaaataaatacatacacaattttaaagtcacctgtagccctacccttagaggtacccagggttaacattttggtggtattgtcttatcaatttttccgttgatacattcagcaaatttggagcacattgaccatggagttttgtgtccaaatccaatctgaatttacctggaagaggccttgacacctgcatggaaatgagctaagaaaaccactggagccttgggagctctttggcctcctggctggcccagtaatatctgagctcctttggttaatttataactgatataaaactacatcttctttataatataaattgtacctgtgagtctagaagctttaaatgtgtttaaattaaaatattcaagctaaatgttactgctctctcccaaattctgtaagtttgactcccgttaccccaattagaagtaacttctttgtttcatgccacttttatagcatttggtaattctgctataacacatcttgcccctattattaactgtgcacagctacacaaaggtgtgccttctacgtgggaacatggattgtgaatgactctgtaatgaggcctgagtcttagttatctttccactcactccccgtctcccctttccaaccccaaaggctcacgataggggctcactaaatgtcagtgtttcaccaaagtattttttccattgtattaagagtccagtcactgtatatggaagtattttattttttatttttttatatcacttgagtccactagtagtacttccttgctctgtttgacttgtcagatacaaagacacgggattagattttgggtggtaaaattgtgatacgcatggctgttgatggagtggaacatcttagtgatgtgagaaaggtcattttagttataaatgtaaaccaattactttagcacaacaataaagatgttctggaaattattataattattttagttaatggacttgcctgtaacaagtgcttatgtttggaatgtccattttattttattttcctctacaataaggaatccctaaagttatgccaacaaactggaattggattgagaaagacaaaagcaagtgagcaagtgtattagactaattatctctagtagggaataagcacttagagctaattttttaatttggtttatttattagtagctccctgattgtctgttaagcccctggttcccacagtttggtgtggtcagtcaacttaagcgaccttttaatgcagaatctttacttggttctgaagaggaggcagtagttaaaattgcttcctcttaatgactctgaatgtattgcctgtgattccaaagttgtacataattgttcagacctcctccatccttttaaattgcctgctgcagtaaataactagtttgagtagaactagatcctgtctatctatttggcacatgttctgctgcctggggagtaagcaagctaaagggatgagaaagaccacctccccctaccctggaaattgcactgcaaggcagggcgagaatggggtagctggcagacctggcctccttgttcccagtcttagtttttcttgagagattcagtattcagtaaagaatagcattcaattagtcaaaaaatatatatataacttcttcctttcccttcccatgaatcattgcagtcattccctaagtttcttctctttttttttcatggctgctagtattttattttagaatcacagactctcagcttagagagtcacagtatctcaattatttgctctgttcaatacttaacaatacctcctcactcaattctacataactccagcttagtcttccaaaattcactttcatgatgccactcagcatctcaaatacctttcattggctctctgctgccaaaggataaaggtcaaagtcattagcctcaacagtgggcttcaaccagcctttggacctcagccccatttatccatcacagaggctggtaactagtctcactgctcaggctgtgagtgttcctgatcttgtgacattctgtgctgtgcttttacatggaacagctctttcctctctcttggcccattcagatcctcctcatccagcccccatctgaatcctgtaacagacacaaccacatctacacagtttccacataccacttggaattgctggttatgctgcaatgagagaatgtctttgtctttaaattgtaagcttcatgagggcagggaccatctgtttctctgtctctcctcacagtgccttgagcagtacgttgtctggaatgtcagaaccaataaatacttgtggattgaaacaaaaagagaa

SEQ ID NO: 176055 - DNA, 5151 bp, Homo sapiens
  Payload ID: 14562
  Gene Symbol: RHBDD1
  Gene Name: rhomboid domain containing 1
  Uniprot ID: Q8TEB9
  ENST ID: ENST00000392062
  CDS Start-End: 525-1472
ggccgagccgtccgctttaaggccctcccctcccgcacccggccccaggaacccggggcgccccggatcgggaacgtgcgtgatgacgcacgtgcgcgcgaagacgtggggacgcaggcgggtcgtagagagcgggtccattgtagggggagaaagaaatattcaggatttaaagcagctgctctaaaggctacattcactgcaatgttgagaagggagcctcttaaacagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggagttttgtttgctttgaaagttcttaacaaccattattgccctggaggctttgtcaacattttgggctttcctgtaccgaacagatttgcttgttgggtcgaacttgtggctattcatttattctcaccagggacttccttcgctgggcatctggctgggattcttgttggactaatgtacactcaagggcctctgaagaaaatcatggaagcatgtgcaggcggtttttcctccagtgttggttacccaggacggcaatactactttaatagttcaggcagctctggatatcaggattattatccgcatggcaggccagatcactatgaagaagcacccaggaactatgacacgtacacagcaggactgagtgaagaagaacagctcgagagagcattacaagccagcctctgggaccgaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggcccctatgagtcaactcacagcttgcggggagtgggccttctcctggccttgttcttgctcataaacaggtcacttcctccatgaagagaccagtttccacgctcccatctctcactgctgactcagcgatgcctctgcctcggtctgcttttgaagactgtgaccttcaccaggaggttttacttacaccagtcgggaagattagtccctcattctgcctggagtgccccgtgtttgacttggcagcgggtgtggagccatccccgcgtcctcctggcgcattgccactgtggctgtccaggaacaggatgtggctgccttggccgaatgttgtcctactctccccaaccccggcgcctcagctcctcagctcctcgggcccctgcgtctggctggtgtttgcagggctttcgctctgctctggtattgctctgcctttatagaaagtcttattgaagaagtgtaagaaagacctaaggtggggaagactcctacacacaccattagtatcagtgacaccagcaatgtaggttcccagccccttcccagtggcagcttgtgtgtccaggagataggacatcatttaacgcatcagcaaagtagcagcagatgccacatacagagtagagcgaaggcatttggtggatcggtcactagagatctatcttgcagaaagtatgtttttcctcataaaagtgcctcttaattggccattgtaccagccacttgtcctagccaaatgtccaaaacacgcccttgggccccgccacgttacaatccacagattgtctgtctgagtcgtttaaggcatttcctggtgcttgtgttccatgaataaaaggacaaagtcagaagatcactgatgtcttactgtcaacagagatattttaaaagagagaagcaggaaaagatcttccttttttgatctacaacttatatagttttctgattatgcacataatagatatgccttccagatgcataaggcaaacatctggaaagaaatatacccaaatcttagcaggggttatctttgggagtggagtacatgggattttgctttcttcatttttataattttatattactgtcttggaagatgtgtttatgtgtgtgtgttacttttacaatcaggaaaacatatttaataacatatagtcaagaaaacagacttaaaaataaatactatgtgtccattgagaaaattcacaatataaacagaaatacaaataaatacatacacaattttaaagtcacctgtagccctacccttagaggtacccagggttaacattttggtggtattgtcttatcaatttttccgttgatacattcagcaaatttggagcacattgaccatggagttttgtgtccaaatccaatctgaatttacctggaagaggccttgacacctgcatggaaatgagctaagaaaaccactggagccttgggagctctttggcctcctggctggcccagtaatatctgagctcctttggttaatttataactgatataaaactacatcttctttataatataaattgtacctgtgagtctagaagctttaaatgtgtttaaattaaaatattcaagctaaatgttactgctctctcccaaattctgtaagtttgactcccgttaccccaattagaagtaacttctttgtttcatgccacttttatagcatttggtaattctgctataacacatcttgcccctattattaactgtgcacagctacacaaaggtgtgccttctacgtgggaacatggattgtgaatgactctgtaatgaggcctgagtcttagttatctttccactcactccccgtctcccctttccaaccccaaaggctcacgataggggctcactaaatgtcagtgtttcaccaaagtattttttccattgtattaagagtccagtcactgtatatggaagtattttattttttatttttttatatcacttgagtccactagtagtacttccttgctctgtttgacttgtcagatacaaagacacgggattagattttgggtggtaaaattgtgatacgcatggctgttgatggagtggaacatcttagtgatgtgagaaaggtcattttagttataaatgtaaaccaattactttagcacaacaataaagatgttctggaaattattataattattttagttaatggacttgcctgtaacaagtgcttatgtttggaatgtccattttattttattttcctctacaataaggaatccctaaagttatgccaacaaactggaattggattgagaaagacaaaagcaagtgagcaagtgtattagactaattatctctagtagggaataagcacttagagctaattttttaatttggtttatttattagtagctccctgattgtctgttaagcccctggttcccacagtttggtgtggtcagtcaacttaagcgaccttttaatgcagaatctttacttggttctgaagaggaggcagtagttaaaattgcttcctcttaatgactctgaatgtattgcctgtgattccaaagttgtacataattgttcagacctcctccatccttttaaattgcctgctgcagtaaataactagtttgagtagaactagatcctgtctatctatttggcacatgttctgctgcctggggagtaagcaagctaaagggatgagaaagaccacctccccctaccctggaaattgcactgcaaggcagggcgagaatggggtagctggcagacctggcctccttgttcccagtcttagtttttcttgagagattcagtattcagtaaagaatagcattcaattagtcaaaaaatatatatataacttcttcctttcccttcccatgaatcattgcagtcattccctaagtttcttctctttttttttcatggctgctagtattttattttagaatcacagactctcagcttagagagtcacagtatctcaattatttgctctgttcaatacttaacaatacctcctcactcaattctacataactccagcttagtcttccaaaattcactttcatgatgccactcagcatctcaaatacctttcattggctctctgctgccaaaggataaaggtcaaagtcattagcctcaacagtgggcttcaaccagcctttggacctcagccccatttatccatcacagaggctggtaactagtctcactgctcaggctgtgagtgttcctgatcttgtgacattctgtgctgtgcttttacatggaacagctctttcctctctcttggcccattcagatcctcctcatccagcccccatctgaatcctgtaacagacacaaccacatctacacagtttccacataccacttggaattgctggttatgctgcaatgagagaatgtctttgtctttaaattgtaagcttcatgagggcagggaccatctgtttctctgtctctcctcacagtgccttgagcagtacgttgtctggaatgtcagaaccaataaatacttgtggattg

SEQ ID NO: 176056 - DNA, 538 bp, Homo sapiens
  Payload ID: 14562
  Gene Symbol: RHBDD1
  Gene Name: rhomboid domain containing 1
  ENST ID: ENST00000409053
  CDS Start-End: 14-487
atgcactgggctaatgagaagacagaatgtctctaatcagcagcagaacaaacactcacaaagggtctccttccctcctaggacttccttcgctgggcatctggctgggattcttgttggactaatgtacactcaagggcctctgaagaaaatcatggaagcatgtgcaggcggtttttcctccagtgttggttacccaggacggcaatactactttaatagttcaggcagctctggatatcaggattattatccgcatggcaggccagatcactatgaagaagcacccaggaactatgacacgtacacagcaggactgagtgaagaagaacagctcgagagagcattacaagccagcctctgggaccgaggaaaaccaggtcataaagagacaatggcaagtctcctggaccccaagataaaggtcagaacagacaaaggacccagatgcctgggaagcctgaagcaggccgcagtttggacctaaggaatcctttgaggctgcagggtccctgtagtggagttgagcaaagactca

SEQ ID NO: 176057 - DNA, 576 bp, Homo sapiens
  Payload ID: 14562
  Gene Symbol: RHBDD1
  Gene Name: rhomboid domain containing 1
  ENST ID: ENST00000448992
  CDS Start-End: 205-576
agacgtggggacgcaggcgggtcgtagagagcgggtccattgtagggggagaaagaaatattcaggatttaaagcagctgctctaaaggctacattcactgcaatgttgagaaggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaattt

SEQ ID NO: 176058 - DNA, 777 bp, Homo sapiens
  Payload ID: 14562
  Gene Symbol: RHBDD1
  Gene Name: rhomboid domain containing 1
  ENST ID: ENST00000436481
  CDS Start-End: 615-777
ctttgtttggagacagtctctttctgccacccaggctggagtgcaatggtgcaatcttggatcactgtaaccgctgcctccagggttcaaacgattctcctgcctcagcttcccaggtagctgggattacaggcgtctgccaccacgcccagctaatttttgtatttttagtagagacggtttcaccacgtttgccaagctggtcccgaactcctgacctcaggggtccattgtagggggagaaagaaatattcaggatttaaagcagctgctctaaaggctacattcactgcaatgttgagaagggagcctcttaaacagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgcctta

SEQ ID NO: 176059 - DNA, 556 bp, Homo sapiens
  Payload ID: 14562
  Gene Symbol: RHBDD1
  Gene Name: rhomboid domain containing 1
  ENST ID: ENST00000423616
  CDS Start-End: 103-556
gcgcgaagacgtggggacgcaggcgggtcgtagagagcatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggagttttgtttgctttgaaag

SEQ ID NO: 176060 - DNA, 577 bp, Homo sapiens
  Payload ID: 14562
  Gene Symbol: RHBDD1
  Gene Name: rhomboid domain containing 1
  ENST ID: ENST00000424132
  CDS Start-End: 174-577
agcagctccccagcctccggctgcgctggggcccggaaggacgaagcttcccggcagagaacctgggcagaggcgtccgttgggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgactt

SEQ ID NO: 176061 - DNA, 596 bp, Homo sapiens
  Payload ID: 14562
  Gene Symbol: RHBDD1
  Gene Name: rhomboid domain containing 1
  ENST ID: ENST00000437454
  CDS Start-End: 446-596
gtgatgacgcacgtgcgcgcgaagacgtggggacgcaggcgggtcgtagagagcgggtccattgtagggggagaaagaaatattcaggatttaaagcagctgctctaaaggctacattcactgcaatgttgagaagggagcctcttaaacagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtata

SEQ ID NO: 176062 - DNA, 371 bp, Homo sapiens
  Payload ID: 14562
  Gene Symbol: RHBDD1
  Gene Name: rhomboid domain containing 1
  ENST ID: ENST00000443477
  CDS Start-End: 354-371
acgtgcgcgcgaagacgtggggacgcaggcgggtcgtagagagcggagcctcttaaacagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggttcagccgtctgtatatctccccagatacctgaaactgaccacctgagtacgttttcccattgctgagctgtttccctgatatctggccatgcaacggagatcaaga

SEQ ID NO: 176063 - DNA, 1802 bp, Homo sapiens
  Payload ID: 14563
  Gene Symbol: RHBDD2
  Gene Name: rhomboid domain containing 2
  Uniprot ID: Q6NTF9
  ENST ID: ENST00000006777
  CDS Start-End: 136-1230
atggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcactgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctga

SEQ ID NO: 176064 - DNA, 1878 bp, Homo sapiens
  Payload ID: 14563
  Gene Symbol: RHBDD2
  Gene Name: rhomboid domain containing 2
  Uniprot ID: Q6NTF9
  ENST ID: ENST00000318622
  CDS Start-End: 630-1301
gccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagccactatggaaggaggggtcaggattacagcagaggagactggcacacagagtgttaagtgacacccactcaatccaccccgaagctgttacacttaattaaccctcaaactgcccagtgagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcactgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctgacctgc

SEQ ID NO: 176065 - DNA, 1274 bp, Homo sapiens
  Payload ID: 14563
  Gene Symbol: RHBDD2
  Gene Name: rhomboid domain containing 2
  Uniprot ID: Q6NTF9
  ENST ID: ENST00000428119
  CDS Start-End: 31-702
gccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcactgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctga

SEQ ID NO: 176066 - DNA, 1831 bp, Homo sapiens
  Payload ID: 14563
  Gene Symbol: RHBDD2
  Gene Name: rhomboid domain containing 2
  ENST ID: ENST00000454791
  CDS Start-End: 80-319
gggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagccactatggaaggaggggtcaggattacagcagaggagactggcacacagagtgttaagtgacacccactcaatccaccccgaagctgttacacttaattaaccctcaaactgcccagtgagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcactgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtc

SEQ ID NO: 176067 - DNA, 1794 bp, Homo sapiens
  Payload ID: 14564
  Gene Symbol: RHBDD3
  Gene Name: rhomboid domain containing 3
  Uniprot ID: Q9Y3P4
  ENST ID: ENST00000216085
  CDS Start-End: 426-1586
gggagacggagatcggcgggagggctgggggaagggacccggactagaacaactgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggca

SEQ ID NO: 176068 - DNA, 755 bp, Homo sapiens
  Payload ID: 14564
  Gene Symbol: RHBDD3
  Gene Name: rhomboid domain containing 3
  ENST ID: ENST00000406335
  CDS Start-End: 346-755
ggcccgggccagcggggaagggtccccaaggccggtcggctgggtgggaggcctcgaacgccgtgcctggccccgagaccctatccccggtaacggtcgaggtggagcaggccctttaatcatccctcatccgatatccttgtttctacagaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctag

SEQ ID NO: 176069 - DNA, 1555 bp, Homo sapiens
  Payload ID: 14564
  Gene Symbol: RHBDD3
  Gene Name: rhomboid domain containing 3
  ENST ID: ENST00000413137
  CDS Start-End: 393-662
gggacccggactagaacaactgctgactaatccgcgggccgcggggaatgggtggcgcgccagccggtcggcaggggtcacgcggccgggtgtgcgcggaatggattcagggttctcgggtcgcgcccgggagctagagtcctgactcccagccggggtccccgaccggcctttcggggttgccgggcgcgctctgcaaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggagacggggtctatgttgcccaggctggtcttgaactcctggcctcaagtgatcctcccgtctcagcctccccaagtgctgggattatacagctgtgagccactgcgtccagccctaagatgattcatacctatcggggaaaacagtgccactggagagaacaggctggcctctgcactctggattggtgacaggagttatccaggcctgtctgaaggcaatagcagacagatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtac

SEQ ID NO: 176070 - DNA, 900 bp, Homo sapiens
  Payload ID: 14564
  Gene Symbol: RHBDD3
  Gene Name: rhomboid domain containing 3
  ENST ID: ENST00000414672
  CDS Start-End: 316-900
tcaggagggatgaaccaccgcttactcgttcttcgcgtccgcaactcttgtcccagtcctctctaaagagcgcccgacgtgacactcgggccaaaatagcatctaaggggccagagcggggaaggggaaactgaggcccaaggaaattgagtatctctgcaaagtcaccagctgagttcgaaccagacagatcctgggaccccctactctatccgccaccggaagaatctccgtccttgtctttccattctgccctcccggcttcccagtaagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggcctggtcctggccccggagctgttgctggacccctggcaggtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctatgcagctggggccttccggtggctggaaccctcagagcgacggctgcaggtg

SEQ ID NO: 176071 - DNA, 1560 bp, Homo sapiens
  Payload ID: 14565
  Gene Symbol: RHBDL1
  Gene Name: rhomboid, veinlet-like 1 (Drosophila)
  Uniprot ID: O75783
  ENST ID: ENST00000219551
  CDS Start-End: 28-1344
cttggaccttggccctcgctttccaggatgggtagggtggaagacgggggaacaactgaggagctggaggactgggacccaggcaccagtgccctgccagctcctgggatcaagcagggtcccagggaacagacaggcacggggcccctgtcccaaaagtgctgggagcctgagcctgatgctcccagccagcctggcccagccctttggtccaggggtcgggcccgcactcaggccttggctggcggctcctcactgcagcagctggaccccgagaacacaggcttcatcggtgcggacaccttcactggcctggtgcacagccatgagctgcccctggacccggccaagctggacatgctggtggccctggctcagagcaacgagcagggccaggtctgctaccaggagctggtggacctgatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccagatcatcgtgttcctgtgttacggggcccgcctcaacaagtgggtgctgcagacctaccaccccgagtacatgaagagcccccttgtgtaccaccccgggcaccgtgcccgcgcctggcgcttcctcacctacatgttcatgcacgttgggctggagcagctggggttcaacgccctcctgcagctgatgatcggggtgcccctggagatggtgcacggcctgctccgcatcagcctgctctacctggcaggcgtgctggcaggctccctaaccgtctccatcaccgacatgcgggccccggtggtgggaggctccggcggggtctacgccctgtgctcggcacacctggccaacgttgtcatgaactgggctgggatgagatgtccctacaagttgctgaggatggtgctggccttggtgtgcatgagctccgaggtgggccgggccgtgtggctgcgcttctccccgccgctgcccgcctcgggcccacagcccagcttcatggcgcacctggcaggcgcggtggtgggggtgagcatgggcctgaccatcctgcggagctacgaggagcgcctgcgggaccagtgcggctggtgggtggtgctgctggcctacggcaccttcctgctcttcgccgtcttctggaacgtcttcgcctacgacctgctgggcgcccacatccccccaccgccctgaccggctacctgaggctgcacaggccagggctcgggcatgtggtggccgcccaccaggggccttcacgtctgccctttgtgaacggacgtctcagggctgctgtgccccttgggtgtgggtggcctcaaaggaggccctgtcccagccacccaccccccactcccaggacttgcggtctgagcctttttggataattaataaatattttacacagca

SEQ ID NO: 176072 - DNA, 1463 bp, Homo sapiens
  Payload ID: 14565
  Gene Symbol: RHBDL1
  Gene Name: rhomboid, veinlet-like 1 (Drosophila)
  Uniprot ID: O75783
  ENST ID: ENST00000352681
  CDS Start-End: 126-1247
ggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcagcagctggaccccgagaacacaggcttcatcggtgcggacaccttcactggcctggtgcacagccatgagctgcccctggacccggccaagctggacatgctggtggccctggctcagagcaacgagcagggccaggtctgctaccaggagctggtggacctgatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccagatcatcgtgttcctgtgttacggggcccgcctcaacaagtgggtgctgcagacctaccaccccgagtacatgaagagcccccttgtgtaccaccccgggcaccgtgcccgcgcctggcgcttcctcacctacatgttcatgcacgttgggctggagcagctggggttcaacgccctcctgcagctgatgatcggggtgcccctggagatggtgcacggcctgctccgcatcagcctgctctacctggcaggcgtgctggcaggctccctaaccgtctccatcaccgacatgcgggccccggtggtgggaggctccggcggggtctacgccctgtgctcggcacacctggccaacgttgtcatgaactgggctgggatgagatgtccctacaagttgctgaggatggtgctggccttggtgtgcatgagctccgaggtgggccgggccgtgtggctgcgcttctccccgccgctgcccgcctcgggcccacagcccagcttcatggcgcacctggcaggcgcggtggtgggggtgagcatgggcctgaccatcctgcggagctacgaggagcgcctgcgggaccagtgcggctggtgggtggtgctgctggcctacggcaccttcctgctcttcgccgtcttctggaacgtcttcgcctacgacctgctgggcgcccacatccccccaccgccctgaccggctacctgaggctgcacaggccagggctcgggcatgtggtggccgcccaccaggggccttcacgtctgccctttgtgaacggacgtctcagggctgctgtgccccttgggtgtgggtggcctcaaaggaggccctgtcccagccacccaccccccactcccaggacttgcggtctgagcctttttggataattaataaatattttacacagca

SEQ ID NO: 176073 - DNA, 796 bp, Homo sapiens
  Payload ID: 14565
  Gene Symbol: RHBDL1
  Gene Name: rhomboid, veinlet-like 1 (Drosophila)
  ENST ID: ENST00000561556
  CDS Start-End: 109-796
gagcggagcgggcggagcgggccggctggggcggagcggagtcgtccgcagagcagcccctcccggccgcggccgccgaccccggaccccggcccccggccaggctctatggacaggagctcgctgctgcagctcatccaggagcagcagctggaccccgagaacacaggcttcatcggtgcggacaccttcactggcctggtgcacagccatgagctgcccctggacccggccaagctggacatgctggtggccctggctcagagcaacgagcagggccaggtctgctaccaggagctggtggacctgatcatcgtgttcctgtgttacggggcccgcctcaacaagtgggtgctgcagacctaccaccccgagtacatgaagagcccccttgtgtaccaccccgggcaccgtgcccgcgcctggcgcttcctcacctacatgttcatgcacgttgggctggagcagctggggttcaacgccctcctgcagctgatgatcggggtgcccctggagatggtgcacggcctgctccgcatcagcctgctctacctggcaggcgtgctggcaggctccctaaccgtctccatcaccgacatgcgggccccggtggtgggaggctccggcggggtctacgccctgtgctcggcacacctggccaacgttgtcatgaactgggctgggatgagatgtccctacaagttgctgaggatggtgctggccttggtgtgcatgagctccgaggtgggccgggccgtgtggctgcgcttctccccgccgctgcccgcctcgggcc

SEQ ID NO: 176074 - DNA, 2129 bp, Homo sapiens
  Payload ID: 14566
  Gene Symbol: RHBDL2
  Gene Name: rhomboid, veinlet-like 2 (Drosophila)
  Uniprot ID: Q9NX52
  ENST ID: ENST00000289248
  CDS Start-End: 1010-1921
gatagggtctcgctttatcactcaggatggagtgtagtgccacgatcttggctcactgcaacctccacctcccgggttcaagcgattctcctgcctcagcatccccagtagctgggattaaaggcatctgccacctcacctggctaattttttgggtacttttcgtagagatggggttttaccatgttggtcaggctggtctcgaatgcccgacctcaggtgatccgcccgcctctgcctcccaaagtgctgggattataggcgtgagccaccgcgccctgcccgagtcaggtttttttattgcaaaagatgggaactgattctggctaattaaatcaggaaatgaattttattgaaagcacattgagtaagttacagaatcacttgaaggctgtagaaacaaggcttgggaaaaaagcagaaacagagaccaggtacctagaattacaccaaattccatcacagagccagataggtgaggacagcctcagtgctgctgctgctgaacgcccagtgctgctgcctttgtcacagccacagctggcgttggatgctggatgccatgctgaccccagtggcaaggcgtctggacactggatactgctgccactgctgcaaccactgtaaagaattttttccatcctcacctccagcctcagaaatcctaagcaaatgcagctgattggtcaagctgccctagctgcctagggacatgcaaaagtgaatattgggcatggttaatgtctgtagtgggatccgtttcctgctgcccaccaggagaagataaattccccaagaaaactgacaaatgacgactacgtacatgttgtcaaagaatccactggaagtctttgacatttgcagattcaacacttgcaattttggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaa

SEQ ID NO: 176075 - DNA, 1837 bp, Homo sapiens
  Payload ID: 14566
  Gene Symbol: RHBDL2
  Gene Name: rhomboid, veinlet-like 2 (Drosophila)
  Uniprot ID: Q9NX52
  ENST ID: ENST00000372990
  CDS Start-End: 229-1140
agagcgggatcttcagggcagcgggcaaccccttggcccaggaagcctggaacgcaaggaccggagggcgtgggctgggacgcccctaccttggtctttcagggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaagaagaagagagaaaagaagggtagtaaaaactagagattggggccaggcgcagtggctcacgcctgtaatcccagcactttgggaggctgaggcgggtgaaatcacctgaggtcatgagttcaagaccagcctgaccaatatggtgaaaccctgtctctactaaagaaaatacaaaaattagccgggcgtggtggcgtgtgcctgtagtcccagctacttgcgaggctgaggcaggagaattgcttgaacctgggaggcgaaggttgcagtgagccgagattgcgccactgcactccagcctgggtgacagagcgacactcggtctcaaaaaacaaaacaaaacaaaacaaaattagagattgggtctttcccaggcatatggtattctataaaacagacttactctccttggaggatatattttggagaatgcttcataaaatctatgaatactgtacaatgctgataataaaaactttttatacctg

SEQ ID NO: 176076 - DNA, 697 bp, Homo sapiens
  Payload ID: 14566
  Gene Symbol: RHBDL2
  Gene Name: rhomboid, veinlet-like 2 (Drosophila)
  Uniprot ID: Q9NX52
  ENST ID: ENST00000540558
  CDS Start-End: 244-642
ggaggagcgcctggcagagcgggatcttcagggcagcgggcaaccccttggcccaggaagcctggaacgcaaggaccggagggcgtgggctgggacgcccctaccttggtctttcagggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctgggtaagcaatgatagttaagcccctggtatcagaggtgattatatcattgtaacctctaa

SEQ ID NO: 176077 - DNA, 4661 bp, Homo sapiens
  Payload ID: 14567
  Gene Symbol: RHBDL3
  Gene Name: rhomboid, veinlet-like 3 (Drosophila)
  Uniprot ID: P58872
  ENST ID: ENST00000269051
  CDS Start-End: 15-1229
accccgtctcggccatgggcgagcaccccagcccgggccccgcggtggccgcctgcgccgaggcggagcgcatcgaggagctggaacccgaggccgaggagcggctgcccgcggcgccggaggaccactggaaagtcctgtttgatcagtttgaccctgggaacacaggctacattagcacaggcaagttccggagtcttctggagagccacagctccaagctggacccgcacaaaagggaggtcctcctggctcttgccgacagccacgcggatgggcagatcggctaccaggattttgtcagcctaatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagggtccttggcagtgtctgtggctgacatgaccgctccagtcgtgggctcttctggaggggtgtatgctctcgtctctgcccatctggccaacattgtcatgaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcaccagctcagctaggccgggcagacaaggacagaagactctgggccactgtaatgtttgtgtttagatttggacacacagtggagacccttttctgaaaggcatctggcggaggagttgatgtggctgctgtcgtttttctcggctgctctgatgacatcgggccagggtgaaggtctggggtggggtgtgagagtggccctccctcacctgggctgggcttcttccatggggccagggggtgccccctcactgctgcggattgagcagcagcttcttcctcctcctctaccctcagagaccctaagagacatgggaaggctcgaaggttgttgcgtccaggcatggcccctctctagctcagaaataattgcaggccatgtggtgtctccttgacacctgctgtgtctggggctccagtaagaagagggcctactggacatgtcagctgtgacctggctgaaaccagggtgccctcctgggctggttggtgtgcaccggggcatgatctgttgtgcctgggttgggcagagcagggagcctgtaggctctaggacccctcttgtgctgggggtacccagtgagagggacccatgcagggggaataaacttcattccaagttccaccctggagaagacagacccaggaccagcttcagacttctccctccctttcttccaggatattggcatctcacacgggtgccccagcctccatgcccagccttgttttagggtctttttctttccttttgctgccctgacactactttgtgcctctctttggttatggagacagtgttttgaaacattcatgcgtgtgtgtgtgtgtgtgcgtatatgtgtgtatgtgatgggaaaggtaactgaggcacgacagcgcctgcagagaaggcatggaggatgcagggggcccatgtgggcatccgtgagaggtggcagaccgtggtgtgctgtggttgctgaatgtccttgctttgacaaagcctgcccccttccttcccatctcctgtcccttccacacctgcccctgagcatcactgaccggtggcagaatggccctgctggagggagagctcaagccctccaaggatccctggatgctgaggtttgccaggttcagctcttgtttccgtctgagatggccttcatatccaaaaaggttccatcctatctcccttaggagagaaagagctttgggggcgcaagagaggctggggtaggaatgttgaggccatgtgtccatttaagttagggggacaggaggctacaggaagaggaattccagtttagttggaaaactttgcctcaggagaattgttgggtgcatggatgaacctcagagggagggcagccagtagcctcggaggcttggatgcgggagagaacatggtggttatcaaatccaccccaccccattacacaggtgagaaaacaagatggagggaatgaccctcctaacaggagctggtgcaggccccgaatggagggcatgaggatgacctttgacaaaagatgacactccctttatcgtgctcttggaattctcaaccactgacagcccagaagaacaaagaacgccaggcctgggaggaggcaggggggctgggcgtgtccagaaacaggggcaggagtgtgggaacggtcttcctccagcctggtgcccatcctggcccttgagtgtagcagggtccagggtcagtcaggccaggcatttggggtcttgggccacagtggcttcccatcctggtgactacatgtaaatgggctcactcactcactggcaggcgaggcccagccataccgcatcttggcccactgctaaatagattgccctggcctcatccacatatgtagttccctaggtcctgctcccctgcaccagtgccatgctgagggccgcagcctgtggcactgtgggcccacgcctttggcggtgttgcgtcagcctggggcgtcttgtgtgtgccctgcccaccgttctctgccctagtgatagaaagatgtagatggaagtcagtgcctcagaggaggaggctctgaggctgtggagctgggctcagggaagaccaggggaggatgcagaaggagtcaggacattgctgcctctgcctgggctgcagccgcactaagctgagcgatgaggtcctttcctggagggatggagaatcccctccagattcctgtcctggcccctggggattctgtggtgtgggtggaatgagcagagtgccacctctgtctggtatgacctggagagggggcttcctctcttaggggtgagaaagcattgaactagaagattctagaaatccctcatagaagcactcagctccctcggggactcccagggaagcttgttactgagaaggacagtggaggcggaatcgtgtctcccaccatgttaagtgtgtcctctgctgccaaggaccctcgtctacaccttagaccaccagccccagctgttctctgtcagcacacccacctccatcccctctcccaaccatgacttccaagcggggccacagggtggggtcatagggtcacttcacctgacccaggcctctccccaggtcaggaggcagctgtctggtcagaggggttctctttgtggcatctggctttctcctcagcaggtcccaccaccctctcagcagcacttccccatggccaaggctggccgtgtcctctgtgcctctttccttgtctgaggtggctgccagcccagggggtggtgtgtaaatcttcaggctggtggaggtaggttggccttttatccacaggatacagaaactgaaagctggggaatccccaaacagcagccatagactcactggctctcattaaacgggagaggaatcacagaaactggggaagggaaaacaaaccttcaaaggagaaatttcgctttaatgacaccattcatcattcgttttttaattaggaaaagctccctaatgaggctcttttgccagctaataggactctcgatttccatgagaaccattcttgcccagaggattaggggagctgttgctcaccacaccaggatcttcccccagcgtccaatttaatttgcaaatacgtaatgcagattccctgggtgccgtgaaagcctttcctggcatcattcatgttgctccccgtgctggctggaaagcacggttctcctctgccttaaaaacagtgcccaacagtgaactgcccctccgaggacttgagtaagtggaaaaaacaaaacacagactgcaatgtttgtttctaagtatttttgtattgtgtacattctgtatatttttgttgtaacatattatttgagcacagattccattaaatattttttttctttttccaagc

SEQ ID NO: 176078 - DNA, 1262 bp, Homo sapiens
  Payload ID: 14567
  Gene Symbol: RHBDL3
  Gene Name: rhomboid, veinlet-like 3 (Drosophila)
  ENST ID: ENST00000431505
  CDS Start-End: 15-1262
accccgtctcggccatgggcgagcaccccagcccgggccccgcggtggccgcctgcgccgaggcggagcgcatcgaggagctggaacccgaggccgaggagcggctgcccgcggcgccggaggaccactggaaagtcctgtttgatcagtttgaccctgggaacacaggctacattagcacaggcaagttccggagtcttctggagagccacagctccaagctggacccgcacaaaagggaggtcctcctggctcttgccgacagccacgcggatgggcagatcggctaccaggattttgtcagcctaatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcaccagctcagctaggccgggcagacaaggacagaagactctgggccactgtaatgttt

SEQ ID NO: 176079 - DNA, 1338 bp, Homo sapiens
  Payload ID: 14567
  Gene Symbol: RHBDL3
  Gene Name: rhomboid, veinlet-like 3 (Drosophila)
  Uniprot ID: P58872
  ENST ID: ENST00000538145
  CDS Start-End: 14-1204
ccccgtctcggccatgggcgagcaccccagcccgggccccgcggtggccgcctgcgccgaggcggagcgcatcgaggagctggaacccgaggccgaggagcggctgcccgcggcgccggaggactttgaccctgggaacacaggctacattagcacaggcaagttccggagtcttctggagagccacagctccaagctggacccgcacaaaagggaggtcctcctggctcttgccgacagccacgcggatgggcagatcggctaccaggattttgtcagcctaatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagggtccttggcagtgtctgtggctgacatgaccgctccagtcgtgggctcttctggaggggtgtatgctctcgtctctgcccatctggccaacattgtcatgaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcaccagctcagctaggccgggcagacaaggacagaagactctgggccactgtaatgttt

SEQ ID NO: 176080 - DNA, 1341 bp, Homo sapiens
  Payload ID: 14567
  Gene Symbol: RHBDL3
  Gene Name: rhomboid, veinlet-like 3 (Drosophila)
  ENST ID: ENST00000578006
  CDS Start-End: 15-170
accccgtctcggccatgggcgagcaccccagcccgggccccgcggtggccgcctgcgccgaggcggagcgcatcgaggagctggaacccgaggccgaggagcggctgcccgcggcgccggaggaccactggaaagtcctgtttgatcaggaagccttccttgacctctgacctccctgggactggattgggctccctcttgtgtgctcccacagcaaccatcactctgaactgtgattgctggttactaatctgtcttgagcaccaccgtatccctccctgtgcctgatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagggtccttggcagtgtctgtggctgacatgaccgctccagtcgtgggctcttctggaggggtgtatgctctcgtctctgcccatctggccaacattgtcatgaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcaccagctcagctaggccgggcagacaaggacagaagactctgggccactgtaatgtt

SEQ ID NO: 176081 - DNA, 4470 bp, Homo sapiens
  Payload ID: 14567
  Gene Symbol: RHBDL3
  Gene Name: rhomboid, veinlet-like 3 (Drosophila)
  Uniprot ID: P58872
  ENST ID: ENST00000536287
  CDS Start-End: 123-1043
atgtcagaaacatccgaggactacagagaccttggtgataagtgtgtctttctttctctcctcttcttcctctcctgcatggcctccctctctgccagcactggaaagtcctgtttgatcagatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagggtccttggcagtgtctgtggctgacatgaccgctccagtcgtgggctcttctggaggggtgtatgctctcgtctctgcccatctggccaacattgtcatgaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcaccagctcagctaggccgggcagacaaggacagaagactctgggccactgtaatgtttgtgtttagatttggacacacagtggagacccttttctgaaaggcatctggcggaggagttgatgtggctgctgtcgtttttctcggctgctctgatgacatcgggccagggtgaaggtctggggtggggtgtgagagtggccctccctcacctgggctgggcttcttccatggggccagggggtgccccctcactgctgcggattgagcagcagcttcttcctcctcctctaccctcagagaccctaagagacatgggaaggctcgaaggttgttgcgtccaggcatggcccctctctagctcagaaataattgcaggccatgtggtgtctccttgacacctgctgtgtctggggctccagtaagaagagggcctactggacatgtcagctgtgacctggctgaaaccagggtgccctcctgggctggttggtgtgcaccggggcatgatctgttgtgcctgggttgggcagagcagggagcctgtaggctctaggacccctcttgtgctgggggtacccagtgagagggacccatgcagggggaataaacttcattccaagttccaccctggagaagacagacccaggaccagcttcagacttctccctccctttcttccaggatattggcatctcacacgggtgccccagcctccatgcccagccttgttttagggtctttttctttccttttgctgccctgacactactttgtgcctctctttggttatggagacagtgttttgaaacattcatgcgtgtgtgtgtgtgtgtgcgtatatgtgtgtatgtgatgggaaaggtaactgaggcacgacagcgcctgcagagaaggcatggaggatgcagggggcccatgtgggcatccgtgagaggtggcagaccgtggtgtgctgtggttgctgaatgtccttgctttgacaaagcctgcccccttccttcccatctcctgtcccttccacacctgcccctgagcatcactgaccggtggcagaatggccctgctggagggagagctcaagccctccaaggatccctggatgctgaggtttgccaggttcagctcttgtttccgtctgagatggccttcatatccaaaaaggttccatcctatctcccttaggagagaaagagctttgggggcgcaagagaggctggggtaggaatgttgaggccatgtgtccatttaagttagggggacaggaggctacaggaagaggaattccagtttagttggaaaactttgcctcaggagaattgttgggtgcatggatgaacctcagagggagggcagccagtagcctcggaggcttggatgcgggagagaacatggtggttatcaaatccaccccaccccattacacaggtgagaaaacaagatggagggaatgaccctcctaacaggagctggtgcaggccccgaatggagggcatgaggatgacctttgacaaaagatgacactccctttatcgtgctcttggaattctcaaccactgacagcccagaagaacaaagaacgccaggcctgggaggaggcaggggggctgggcgtgtccagaaacaggggcaggagtgtgggaacggtcttcctccagcctggtgcccatcctggcccttgagtgtagcagggtccagggtcagtcaggccaggcatttggggtcttgggccacagtggcttcccatcctggtgactacatgtaaatgggctcactcactcactggcaggcgaggcccagccataccgcatcttggcccactgctaaatagattgccctggcctcatccacatatgtagttccctaggtcctgctcccctgcaccagtgccatgctgagggccgcagcctgtggcactgtgggcccacgcctttggcggtgttgcgtcagcctggggcgtcttgtgtgtgccctgcccaccgttctctgccctagtgatagaaagatgtagatggaagtcagtgcctcagaggaggaggctctgaggctgtggagctgggctcagggaagaccaggggaggatgcagaaggagtcaggacattgctgcctctgcctgggctgcagccgcactaagctgagcgatgaggtcctttcctggagggatggagaatcccctccagattcctgtcctggcccctggggattctgtggtgtgggtggaatgagcagagtgccacctctgtctggtatgacctggagagggggcttcctctcttaggggtgagaaagcattgaactagaagattctagaaatccctcatagaagcactcagctccctcggggactcccagggaagcttgttactgagaaggacagtggaggcggaatcgtgtctcccaccatgttaagtgtgtcctctgctgccaaggaccctcgtctacaccttagaccaccagccccagctgttctctgtcagcacacccacctccatcccctctcccaaccatgacttccaagcggggccacagggtggggtcatagggtcacttcacctgacccaggcctctccccaggtcaggaggcagctgtctggtcagaggggttctctttgtggcatctggctttctcctcagcaggtcccaccaccctctcagcagcacttccccatggccaaggctggccgtgtcctctgtgcctctttccttgtctgaggtggctgccagcccagggggtggtgtgtaaatcttcaggctggtggaggtaggttggccttttatccacaggatacagaaactgaaagctggggaatccccaaacagcagccatagactcactggctctcattaaacgggagaggaatcacagaaactggggaagggaaaacaaaccttcaaaggagaaatttcgctttaatgacaccattcatcattcgttttttaattaggaaaagctccctaatgaggctcttttgccagctaataggactctcgatttccatgagaaccattcttgcccagaggattaggggagctgttgctcaccacaccaggatcttcccccagcgtccaatttaatttgcaaatacgtaatgcagattccctgggtgccgtgaaagcctttcctggcatcattcatgttgctccccgtgctggctggaaagcacggttctcctctgccttaaaaacagtgcccaacagtgaactgcccctccgaggacttgagtaagtggaaaaaacaaaacacagactgcaatgtttgtttctaagtatttttgtattgtgtacattctgtatatttttgttgtaacatattatttgagcacagattccattaaatattttttttctttttc

SEQ ID NO: 176082 - DNA, 1614 bp, Homo sapiens
  Payload ID: 14568
  Gene Symbol: ROPN1
  Gene Name: rhophilin associated tail protein 1
  Uniprot ID: Q9HAT0
  ENST ID: ENST00000184183
  CDS Start-End: 342-980
tagcacttcatagactgctatcacgcattcatttttactagtacctattgaacactaagttccaggcactgggctaggcactgggatggtgtggtgagcaaaaactgaccagtcctgccgtggagtttgctgggggagacacatgttactcaaagaatcacactaaggatagcaatttatctcaaagctgcaagttcctgccatctacatgtgcccagagtccccaaaattgagtgtcaaacagaggctgggtgacctcctgtccaggattgctctcatcgtatgaatcgaagttttcatcttaacgtatttttttctcctgagaataggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatcaattttcttgtacaactggtacacactaataaacaattaaacatatgagatcagaaatgtgcagaattaagatgtgaaattgttggaacaaaacaccttcattaccagattagtattcttcccacatggacactgagtaaaagtggctgacaaagcatggatagaaaatgcatcttcaatcaaagccagactgtcagattttaaaaggtagtatgttaaccagacacagtgttgttgttctgtgattgttaggcataatttagatgagtgtcttttatatggtcaattgaagtttttaccagtttatttctccatttgttggtactgtgctagtcattcattcatcctctcactcatcaatatttattgaggttagctatgtgccaggaatagggttgcaagaaataaatacaggacacccagttaaatttgaatttcagacaaacaacaaatatgttttgttttggtttttgctaaacctggcagcattccaggaactatgctggcttctgagcacatacaaataaataatatcagaattctgccttcaa

SEQ ID NO: 176083 - DNA, 1007 bp, Homo sapiens
  Payload ID: 14568
  Gene Symbol: ROPN1
  Gene Name: rhophilin associated tail protein 1
  Uniprot ID: Q9HAT0
  ENST ID: ENST00000405845
  CDS Start-End: 229-867
gccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatcaattttcttgtacaactggtacacactaataaacaattaaacatatgagatcagaaa

SEQ ID NO: 176084 - DNA, 683 bp, Homo sapiens
  Payload ID: 14568
  Gene Symbol: ROPN1
  Gene Name: rhophilin associated tail protein 1
  ENST ID: ENST00000467907
  CDS Start-End: 295-683
gaggttctactgctctccttcttaagaagggtgggaggcactcggtctctccccacacctctcgcctgaggccaggcgccaggtgtcgcctgaagccagacagccggtttgggagcgagcctgagcaatttatctcaaagctgcaagttcctgccatctacatgtgcccagagtccccaaaattgagtgtcaaacagaggctgggtgacctcctgtccaggattgctctcatcgtatgaatcgaagttttcatcttaacgtatttttttctcctgagaataggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctct

SEQ ID NO: 176085 - DNA, 1376 bp, Homo sapiens
  Payload ID: 14568
  Gene Symbol: ROPN1
  Gene Name: rhophilin associated tail protein 1
  Uniprot ID: Q9HAT0
  ENST ID: ENST00000495093
  CDS Start-End: 312-488
aacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagagtccccaaaattgagtgtcaaacagaggctgggtgacctcctgtccaggattgctctcatcgtatgaatcgaagttttcatcttaacgtatttttttctcctgagaataggccaaccaatcaatggctcagacagataagccaacatgcatcccgccggagctgccgaagatgctgaaggagtttgccaaagccgccattagggtgcagccgcaggacctcatccagtgggcagccgagtacgtgctcctttctcgccttcaccccttggaggacggccggagacagagggtcctgtaaaaccgcggaggttgtcatggctgcagctaggaagtccggactaactggcatcgtctttgttttagctcttgcattgctttgatgctttaaaatccacacataaatgctacatctagctgggcaaggatgggatgcctcccctaagggagccagattgagcagtaggacgccaggtcaataggccgtgtcctggggcaagcagcaagttagatgaccgcgtcacaccagcgtatgcacacccacctcctccctgcacgccttttcccactcccggtggaaagaagggctgggaatctccgaagcttaatctgcctttcttcgttctcctgtctcaccactagatggcagcagtgcagccgggggagggaagcgacagccctgggtggatggggtgggaccagtcctgctagttcactcctttaaggagacacttcctcccctgctgttaaaactcatacttggacccaaccaaagaccctttatatcttgtcttggaggaaattattgttattttctttagtgtttctctgaactgattttgttctgccaacataaagatgtccgcacagtacacactgcattctggggaaaggccaagcagagtgatggggtcctcaggcatggctgaaaacagtgtgcctcaaacacgggtgccttctttcaggagagacctccagaggctgctcagtagatggagcttacacaacaatcgctgcgggcctggattgaagtagctttgcacagaaagcctctcagctatgaaattgctccttggacaaacttgcctgcttgaaactggggaaccaggacttgagacaggagttggaagataactagacctcacggaccattttcaggctatttttactgtttgatgattccctgctt

SEQ ID NO: 176086 - DNA, 548 bp, Homo sapiens
  Payload ID: 14568
  Gene Symbol: ROPN1
  Gene Name: rhophilin associated tail protein 1
  ENST ID: ENST00000496145
  CDS Start-End: 316-548
gctacccctggtgacctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagcaatttatctcaaagctgcaagttcctgccatctacatgtgcccaggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctca

SEQ ID NO: 176087 - DNA, 566 bp, Homo sapiens
  Payload ID: 14568
  Gene Symbol: ROPN1
  Gene Name: rhophilin associated tail protein 1
  Uniprot ID: Q9HAT0
  ENST ID: ENST00000484329
  CDS Start-End: 390-566
gtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagcaatttatctcaaagctgcaagttcctgccatctacatgtgcccagagtccccaaaattgagtgtcaaacagaggctgggtgacctcctgtccaggattgctctcatcgtatgaatcgaagttttcatcttaacgtatttttttctcctgagaataggccaaccaatcaatggctcagacagataagccaacatgcatcccgccggagctgccgaagatgctgaaggagtttgccaaagccgccattagggtgcagccgcaggacctcatccagtgggcagccgagtacgtgctcctttctcgccttcaccccttggaggacggccggagacagagggtcctgtaa

SEQ ID NO: 176088 - DNA, 727 bp, Homo sapiens
  Payload ID: 14568
  Gene Symbol: ROPN1
  Gene Name: rhophilin associated tail protein 1
  ENST ID: ENST00000460743
  CDS Start-End: 379-727
aggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagttccaggcactgggctaggcactgggatggtgtggtgagcaaaaactgaccagtcctgccgtggagtttgctgggggagacacatgttactcaaagaatcacactaaggatagcaatttatctcaaagctgcaagttcctgccatctacatgtgcccaggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggaga

SEQ ID NO: 176089 - DNA, 2056 bp, Homo sapiens
  Payload ID: 14568
  Gene Symbol: ROPN1
  Gene Name: rhophilin associated tail protein 1
  Uniprot ID: Q9HAT0
  ENST ID: ENST00000479867
  CDS Start-End: 250-426
agcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggccaaccaatcaatggctcagacagataagccaacatgcatcccgccggagctgccgaagatgctgaaggagtttgccaaagccgccattagggtgcagccgcaggacctcatccagtgggcagccgagtacgtgctcctttctcgccttcaccccttggaggacggccggagacagagggtcctgtaaaaccgcggaggttgtcatggctgcagctaggaagtccggactaactggcatcgtctttgttttagctcttgcattgctttgatgctttaaaatccacacataaatgctacatctagctgggcaaggatgggatgcctcccctaagggagccagattgagcagtaggacgccaggtcaataggccgtgtcctggggcaagcagcaagttagatgaccgcgtcacaccagcgtatgcacacccacctcctccctgcacgccttttcccactcccggtggaaagaagggctgggaatctccgaagcttaatctgcctttcttcgttctcctgtctcaccactagatggcagcagtgcagccgggggagggaagcgacagccctgggtggatggggtgggaccagtcctgctagttcactcctttaaggagacacttcctcccctgctgttaaaactcatacttggacccaaccaaagaccctttatatcttgtcttggaggaaattattgttattttctttagtgtttctctgaactgattttgttctgccaacataaagatgtccgcacagtacacactgcattctggggaaaggccaagcagagtgatggggtcctcaggcatggctgaaaacagtgtgcctcaaacacgggtgccttctttcaggagagacctccagaggctgctcagtagatggagcttacacaacaatcgctgcgggcctggattgaagtagctttgcacagaaagcctctcagctatgaaattgctccttggacaaacttgcctgcttgaaactggggaaccaggacttgagacaggagttggaagataactagacctcacggaccattttcaggctatttttactgtttgatgattccctgcttaggagggtttcagtgggaaagtgagagtgagagaggccgttgagagaaagccagtgagttggggaagggaagatgtcctcaggctgaggttgtgagtgggtgtcctgggcagatggtggggagagtgtggacacctttgagaagacacaaaatggcatctaagaggggcctttcggagtctctgggccagtgctgtgctcctggactggattaggatgtagcttttacaattggaaggaaaataagccagtggtgctcataaaaagaaacataaatgggggttgctttgcctagtaatgagccctgtttagttctccattttaaattttatatattgcctctaagattgaactttagcttcagaagactaatttattttggcatagtcagatagacagactttatcttatacgttagtttcaaacccatttgattgttcttgtgctgccgttttatagtaagcaaactgacattgcttagtattgtccctgacatttatggaagaggcattccactattgtagactgcttgctctcgtattgtatcacgtgctataatttttttagacatccatgaaaacttagtttgtagtttaaccacaatgaaaaaggagggcatgacctaagagccccctccattctatccagacatgaaaagcactgctcagatggttgtatgtgacttacttaaaacctgtagcattttagagaataaaactctgcaaagtgtttccaagacaaaa

SEQ ID NO: 176090 - DNA, 1909 bp, Homo sapiens
  Payload ID: 14568
  Gene Symbol: ROPN1
  Gene Name: rhophilin associated tail protein 1
  Uniprot ID: Q9HAT0
  ENST ID: ENST00000459660
  CDS Start-End: 103-279
cgccgctgctgtcacccccggccgctgctgccctccccgccgagcaatttatctcaaagctgcaagttcctgccatctacatgtgcccaggccaaccaatcaatggctcagacagataagccaacatgcatcccgccggagctgccgaagatgctgaaggagtttgccaaagccgccattagggtgcagccgcaggacctcatccagtgggcagccgagtacgtgctcctttctcgccttcaccccttggaggacggccggagacagagggtcctgtaaaaccgcggaggttgtcatggctgcagctaggaagtccggactaactggcatcgtctttgttttagctcttgcattgctttgatgctttaaaatccacacataaatgctacatctagctgggcaaggatgggatgcctcccctaagggagccagattgagcagtaggacgccaggtcaataggccgtgtcctggggcaagcagcaagttagatgaccgcgtcacaccagcgtatgcacacccacctcctccctgcacgccttttcccactcccggtggaaagaagggctgggaatctccgaagcttaatctgcctttcttcgttctcctgtctcaccactagatggcagcagtgcagccgggggagggaagcgacagccctgggtggatggggtgggaccagtcctgctagttcactcctttaaggagacacttcctcccctgctgttaaaactcatacttggacccaaccaaagaccctttatatcttgtcttggaggaaattattgttattttctttagtgtttctctgaactgattttgttctgccaacataaagatgtccgcacagtacacactgcattctggggaaaggccaagcagagtgatggggtcctcaggcatggctgaaaacagtgtgcctcaaacacgggtgccttctttcaggagagacctccagaggctgctcagtagatggagcttacacaacaatcgctgcgggcctggattgaagtagctttgcacagaaagcctctcagctatgaaattgctccttggacaaacttgcctgcttgaaactggggaaccaggacttgagacaggagttggaagataactagacctcacggaccattttcaggctatttttactgtttgatgattccctgcttaggagggtttcagtgggaaagtgagagtgagagaggccgttgagagaaagccagtgagttggggaagggaagatgtcctcaggctgaggttgtgagtgggtgtcctgggcagatggtggggagagtgtggacacctttgagaagacacaaaatggcatctaagaggggcctttcggagtctctgggccagtgctgtgctcctggactggattaggatgtagcttttacaattggaaggaaaataagccagtggtgctcataaaaagaaacataaatgggggttgctttgcctagtaatgagccctgtttagttctccattttaaattttatatattgcctctaagattgaactttagcttcagaagactaatttattttggcatagtcagatagacagactttatcttatacgttagtttcaaacccatttgattgttcttgtgctgccgttttatagtaagcaaactgacattgcttagtattgtccctgacatttatggaagaggcattccactattgtagactgcttgctctcgtattgtatcacgtgctataatttttttagacatccatgaaaacttagtttgtagtttaaccacaatgaaaaaggagggcatgacctaagagccccctccattctatccagacatgaaaagcactgctcagatggttgtatgtgacttacttaaaacctgtagcattttagagaataaaactctgcaaagtgtttccaagacaaaa

SEQ ID NO: 176091 - DNA, 1006 bp, Homo sapiens
  Payload ID: 14568
  Gene Symbol: ROPN1
  Gene Name: rhophilin associated tail protein 1
  Uniprot ID: Q9HAT0
  ENST ID: ENST00000620893
  CDS Start-End: 247-885
aaatgaacaagggctgtgtaatttttatgtaaaggacataactatttccaacaaaaagtaggggttagcagatggttttctaaccttggcgttgtgtaataatagaatgcatttgtcttgcagagtccccaaaattgagtgtcaaacagaggctgggtgacctcctgtccaggattgctctcatcgtatgaatcgaagttttcatcttaacgtatttttttctcctgagaataggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatcaattttcttgtacaactggtacacactaataaacaatt

SEQ ID NO: 176092 - DNA, 1026 bp, Homo sapiens
  Payload ID: 14569
  Gene Symbol: ROPN1B
  Gene Name: rhophilin associated tail protein 1B
  Uniprot ID: Q9BZX4
  ENST ID: ENST00000251776
  CDS Start-End: 254-892
tggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaa

SEQ ID NO: 176093 - DNA, 713 bp, Homo sapiens
  Payload ID: 14569
  Gene Symbol: ROPN1B
  Gene Name: rhophilin associated tail protein 1B
  Uniprot ID: Q9BZX4
  ENST ID: ENST00000505382
  CDS Start-End: 220-582
aacagccagaggccactggtgtataggatcctcctactctctgactttttttcttgtagttattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcag

SEQ ID NO: 176094 - DNA, 755 bp, Homo sapiens
  Payload ID: 14569
  Gene Symbol: ROPN1B
  Gene Name: rhophilin associated tail protein 1B
  ENST ID: ENST00000508088
  CDS Start-End: 448-755
acgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagggcaaggggaaggcaaggggatcttcaagagaatgtgactgtgggggattatggctttctggccaatttgttacctattgaacactaagttccaggcactgggctaggcactgggatggtgtggtgagcaaaaactgaccagtcctgccgtggagtttgctgggggagacacatgttactcaaagaatcacactaaggatagcaatttatctcaaagcttcaagttcctgccatctacatgtgcccaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatct

SEQ ID NO: 176095 - DNA, 782 bp, Homo sapiens
  Payload ID: 14569
  Gene Symbol: ROPN1B
  Gene Name: rhophilin associated tail protein 1B
  Uniprot ID: Q9BZX4
  ENST ID: ENST00000511082
  CDS Start-End: 286-648
gctttgtgtaactgggcagagctaacacctgagctgttaaagatcctgcattctcagcatgctcttcactaggatttgcaaaggtaactgccacacagagccatctttaccttcctaacaccccctcccgccccttgccatgtgctgggagatgtggacctggcctggggacagggtgtttctcagggccttgtctcaacttctcccacaacctctgtgttgtgtctgtcccctgccctgcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaa

SEQ ID NO: 176096 - DNA, 2050 bp, Homo sapiens
  Payload ID: 14569
  Gene Symbol: ROPN1B
  Gene Name: rhophilin associated tail protein 1B
  ENST ID: ENST00000504401
  CDS Start-End: 250-426
agcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggtcaaccaatcaatggctcagacagataagccaacatgcatcccgccggagctgccgaaaatgctgaaggagtttgccaaagccgccattcgggcgcagccgcaggacctcatccagtggggggccgagtacgtgctcctttctcgccttcatctcttggaggacgggcggggagagagggtcctgtaaaaccgcggaggttgtcatggctgcagccagggggtcgggactaactggcatcgtctttgttttagctcttgcattgctttgatgctttaaaatccacacataaatactacatctagccgggcaaggatgggatgcctcccctaagcgagccagattgagcagtaggacgccaggtcaataggccgtgtcctggggcaagcagcaagttagatgaccgcgtcacaccagcgtatgcacacccacctcctccctgcacgccttttcccactctcggtggaaagaagggctgggaatctccgcagcttaatctgcctttcttcattctcctgtctcaccactagatggcagcagtgcagccgggggagggaagcgacagccctgggtggatggggtgggaccagtcctgctagttcactcctttaaggagacacttcctcccctgctgttaaaactcatacttggacccaaccaaagaggctttgtatctttgaggaaattattgttattttctttggtgtttctctgaactgatttgttctgccaacataatgatgtcctcacagtacacactgcattctggggaaaggccaggcagagtgatggggtcctcaggcatggctgaaaacagtgtgcctcaaacacgggtgccttctttcaggagagacctccagaggctgctcagtagatggagcttacacaacaatcgctgcgggcctggattgaagtagctttgcacagaaagcctctcagctatgaaattgctccttggacaaacttgcctgcttgaaactggggaaccaggacttgagacaggagttggaagataactagacctcacggaccattttcaggctatttttactgtttgatgattccctgcttaggagggtttcagtgggaaagtgagagtgagagaggccgttgagagaaagccagtgagttggggaagggaagatgtcctcaggctgaggttgtgagtgggtgtcctgggcagatggtggggagagtgtggacacctttgagaagacacaaaatggcacctaagaggggcctttcggagtctctgggccagtgttgtgctcctggtctggattaggatgcagcttttacaattggaaggaaaataggccagtggtgctcataaaaagaaacataaatgggggttgctttgcctagtaataagccctgtttagttttccattctaaattttatatattgcctctaagattgaactttagcttcagaagactaatttattttggcatagtcagatagacagactttatcttatacgttagtttcaaacccatttgattgttcttgtgctgccgttttatagtaagcaaaatgacattgcttagtattgtccctgacatttatggaagaggcattccactattgtagactgcttgctctcgtattgtatcacgtgctataatttttttagacatccatgaaaacttagtttgtagtttaaccacaatgaaaaaggagggcatgacctaagagccccctccattctatccagacatgaaaagcactgctcagatggttgtatgtgacttacttaaaacctgtagcattttagagaataaaactctgcaaagtgtttccaagacaaaa

SEQ ID NO: 176097 - DNA, 769 bp, Homo sapiens
  Payload ID: 14569
  Gene Symbol: ROPN1B
  Gene Name: rhophilin associated tail protein 1B
  ENST ID: ENST00000513830
  CDS Start-End: 379-769
aggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagttccaggcactgggctaggcactgggatggtgtggtgagcaaaaactgaccagtcctgccgtggagtttgctgggggagacacatgttactcaaagaatcacactaaggatagcaatttatctcaaagcttcaagttcctgccatctacatgtgcccaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgg

SEQ ID NO: 176098 - DNA, 1088 bp, Homo sapiens
  Payload ID: 14569
  Gene Symbol: ROPN1B
  Gene Name: rhophilin associated tail protein 1B
  Uniprot ID: Q9BZX4
  ENST ID: ENST00000514116
  CDS Start-End: 316-954
gctacccctggtgacctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagcaatttatctcaaagcttcaagttcctgccatctacatgtgcccaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaa

SEQ ID NO: 176099 - DNA, 1066 bp, Homo sapiens
  Payload ID: 14570
  Gene Symbol: ROPN1L
  Gene Name: rhophilin associated tail protein 1-like
  Uniprot ID: Q96C74
  ENST ID: ENST00000274134
  CDS Start-End: 293-985
ctcgcgtcccgggtgcctggataccgagcgcgtccgtagtggcggctggcgctagggaactgcagggtctagggtgttgtcggagtggcagttggtccgaatttctcccgaagcccgcggaggagcgggtaagagccccgcgaatccggccccaacctcgggaacgggatgggaggcggccctggccgcaagccccgcgctgctagcgggtccaccgcgtcgtagccgacagccgcccttcttcctcgcagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcacaca

SEQ ID NO: 176100 - DNA, 1291 bp, Homo sapiens
  Payload ID: 14570
  Gene Symbol: ROPN1L
  Gene Name: rhophilin associated tail protein 1-like
  Uniprot ID: Q96C74
  ENST ID: ENST00000503804
  CDS Start-End: 522-1214
gcggccccaggcgcaggcgggtcccgcagcggggcccgtgccgcccaggcgatcagccccttcacttaacccgcttccctcctagcaggcccgagtcccctagcctcagcctcacgcagccagagcaaggggaagagggagtccttcgtgagttcgccgctcacattcggcggtgggaaaccgatccgaagatgcttttgtaggcgaaacgctcagctcgcgcggctctgaaccaccggggagcagcggctgctgctagtcggactacgccagcacctccttgtccagcccgggagcagccccgcctcgctcagggccgcgtgcgcgtgcgcggctccaggggcggggcctgctcgcgtcccgggtgcctggataccgagcgcgtccgtagtggcggctggcgctagggaactgcagggtctagggtgttgtcggagtggcagttggtccgaatttctcccgaagcccgcggaggagcggcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatca

SEQ ID NO: 176101 - DNA, 3683 bp, Homo sapiens
  Payload ID: 14571
  Gene Symbol: RHPN1
  Gene Name: rhophilin, Rho GTPase binding protein 1
  Uniprot ID: Q8TCX5
  ENST ID: ENST00000289013
  CDS Start-End: 102-2114
cgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctccccagcgaccgagggagagctccccacgcacgagcaggtcttcctgcagccccccacctcctctaagccccgaggccctgtgctgccgcaggagctggaggagcgcaggcagcttggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggggcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgaaggctgcgggagaggcgggcgccagcctgcaggtggtgtcgctgctgcccagctctagactgcccagcttgggggaccgccggcccgtcctgctgggccccagggggcttctaaggagccagagggagcatggttgcaagaccccggcatccacgtgggccagtccccggcccctcctcaactggagccgaaaggcccagcagggcaagactggaggctgcccccagccctgtgccccagtgaagccagctccgccctcatccttgaagcacccagggtggccgtgagggccaggatccctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagcccagtgatgggagctgtggcctcttcacccacacacagaaggatgccagtccctctgtcggtctgaggtcagcttcctggggctgccccaccctgagggctccttacagggtgctcctcacagccatcccatctgtacccccgggctctgtccaccctgctgctgccctgggcacagaccctgaggtctcagtcctgcctccagccaagtttctgcctggtgcccagtgattcctgctgggcaccccttcgctcactgcccctccaccatgcagcagccagacacacccacagcacccgcagacctctaggccgggtcccagacatggccttcccccaaaatacttcctgctgtcctgtctgtgcacagagcaagggactccccacctctgcgccctgtgctggtcatcatgggctctgtgctggtcaacccagcaagtgtcccgtttgcccaggagtccctggtgtcgtggcccaggtctcatggtggccctaagcctgccagccctgctgcccgccttgctgtcctgctctgagcatgggtgccaccctccagctcctgggcgtgtcacttctctctgagcctggggcctgcatgggcccccagccctccccagcctgcttgggccgctcctgctggcctccacaggccgtgagctgtcagtgtctcaagcaggggaagtgagggctgcctccaggcctccgtgtactgggtggacaatggcccccaaaggccgtcggcaagaacaccacctccaggacccctacagcagtgggctcaggacttgggcaccaagaggagagggtgggaagggctgcagagtcagggctgcacccaagaggagccacggagccggagccggagcggaggcccccaccgagggccccagggcctggcaggttccggaagagacagggccagcgggagtcattccctgcagccactagggggcagccgccacccgctcagcagccctgggaggcggcacgggcaggtgcgccttgggagggctgaggcaaagaccccgggtagaaaggcggcccccagctctgcgagacccctgccctcttgtccagtcccttccgagggtccgcaggtgagagcagcctgccctgcatcccaggctctggttccagggtccagggccctgcgctgccacctccctcgtgcttcagccaagaaaatgggggtgcaagtagggtgtttggggtcccagagacgcaggcgccgcggcgcgatcttcctgggcaggagggcagggctccccaacctgcctgagccggggtgggggtccaggtcccccacttgcccttgtgggaaaatccctgtctcagcagaatgggccaaggtcacgcaggtctccccagcacgtgttaatttggttaataaaactgtggatcaagga

SEQ ID NO: 176102 - DNA, 3789 bp, Homo sapiens
  Payload ID: 14571
  Gene Symbol: RHPN1
  Gene Name: rhophilin, Rho GTPase binding protein 1
  Uniprot ID: Q8TCX5
  ENST ID: ENST00000620174
  CDS Start-End: 134-2221
cagtcggggaccggcgcgggcactcaggagcccgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctcccgtgagtgcccaccacacttgcccatggtactgccaaggcccccccgcgcaggctcacagcctctctgtcccccagcagcgaccgagggagagctccccacgcacgagcaggtcttcctgcagccccccacctcctctaagccccgaggccctgtgctgccgcaggagctggaggagcgcaggcagcttggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggggcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgaaggctgcgggagaggcgggcgccagcctgcaggtggtgtcgctgctgcccagctctagactgcccagcttgggggaccgccggcccgtcctgctgggccccagggggcttctaaggagccagagggagcatggttgcaagaccccggcatccacgtgggccagtccccggcccctcctcaactggagccgaaaggcccagcagggcaagactggaggctgcccccagccctgtgccccagtgaagccagctccgccctcatccttgaagcacccagggtggccgtgagggccaggatccctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagcccagtgatgggagctgtggcctcttcacccacacacagaaggatgccagtccctctgtcggtctgaggtcagcttcctggggctgccccaccctgagggctccttacagggtgctcctcacagccatcccatctgtacccccgggctctgtccaccctgctgctgccctgggcacagaccctgaggtctcagtcctgcctccagccaagtttctgcctggtgcccagtgattcctgctgggcaccccttcgctcactgcccctccaccatgcagcagccagacacacccacagcacccgcagacctctaggccgggtcccagacatggccttcccccaaaatacttcctgctgtcctgtctgtgcacagagcaagggactccccacctctgcgccctgtgctggtcatcatgggctctgtgctggtcaacccagcaagtgtcccgtttgcccaggagtccctggtgtcgtggcccaggtctcatggtggccctaagcctgccagccctgctgcccgccttgctgtcctgctctgagcatgggtgccaccctccagctcctgggcgtgtcacttctctctgagcctggggcctgcatgggcccccagccctccccagcctgcttgggccgctcctgctggcctccacaggccgtgagctgtcagtgtctcaagcaggggaagtgagggctgcctccaggcctccgtgtactgggtggacaatggcccccaaaggccgtcggcaagaacaccacctccaggacccctacagcagtgggctcaggacttgggcaccaagaggagagggtgggaagggctgcagagtcagggctgcacccaagaggagccacggagccggagccggagcggaggcccccaccgagggccccagggcctggcaggttccggaagagacagggccagcgggagtcattccctgcagccactagggggcagccgccacccgctcagcagccctgggaggcggcacgggcaggtgcgccttgggagggctgaggcaaagaccccgggtagaaaggcggcccccagctctgcgagacccctgccctcttgtccagtcccttccgagggtccgcaggtgagagcagcctgccctgcatcccaggctctggttccagggtccagggccctgcgctgccacctccctcgtgcttcagccaagaaaatgggggtgcaagtagggtgtttggggtcccagagacgcaggcgccgcggcgcgatcttcctgggcaggagggcagggctccccaacctgcctgagccggggtgggggtccaggtcccccacttgcccttgtgggaaaatccctgtctcagcagaatgggccaaggtcacgcaggtctccccagcacgtgttaatttggttaataaaactgtggatcaagg

SEQ ID NO: 176103 - DNA, 3500 bp, Homo sapiens
  Payload ID: 14572
  Gene Symbol: RHPN2
  Gene Name: rhophilin, Rho GTPase binding protein 2
  Uniprot ID: Q8IUC4
  ENST ID: ENST00000254260
  CDS Start-End: 37-2097
agtccgccgtccgccctccgcgcccgcgccgctagcatgaccgacgcgctgttgcccgcggccccccagccgctggagaaggagaacgacggctactttcggaagggctgtaatccccttgcacaaaccggccggagtaaattgcagaatcaaagagctgctttgaatcagcagatcctgaaagccgtgcggatgaggaccggagcggaaaaccttctgaaagtggccacaaactcaaaggtgcgggagcaagtgcggctggagctgagcttcgtcaactcagacctgcagatgctcaaggaagagctggaggggctgaacatctcggtgggcgtctatcagaacacagaggaggcatttacgattcccctgattcctcttggcctgaaggaaacgaaagacgtcgactttgcagtcgtcctcaaggattttatcctggaacattacagtgaagatggctatttatatgaagatgaaattgcagatcttatggatctgagacaagcttgtcggacgcctagccgggatgaggccggggtggaactgctgatgacatacttcatccagctgggctttgtcgagagtcgattcttcccgcccacacggcagatgggactcctgttcacctggtatgactctctcaccggggttccggtcagccagcagaacctgctgctggagaaggccagtgtcctgttcaacactggggccctctacacccagattgggacccggtgtgatcggcagacgcaggctgggctggagagtgccatagatgcctttcagagagccgcaggggttttaaattacctgaaagacacatttacccatactccaagttacgacatgagccctgccatgctcagcgtgctcgtcaaaatgatgcttgcacaagcccaagaaagcgtgtttgagaaaatcagccttcctgggatccggaatgaattcttcatgctggtgaaggtggctcaggaggctgctaaggtgggagaggtctaccaacagctacacgcagccatgagccaggcgccggtgaaagagaacatcccctactcctgggccagcttagcctgcgtgaaggcccaccactacgcggccctggcccactacttcactgccatcctcctcatcgaccaccaggtgaagccaggcacggatctggaccaccaggagaagtgcctgtcccagctctacgaccacatgccagaggggctgacacccttggccacactgaagaatgatcagcagcgccgacagctggggaagtcccacttgcgcagagccatggctcatcacgaggagtcggtgcgggaggccagcctctgcaagaagctgcggagcattgaggtgctacagaaggtgctgtgtgccgcacaggaacgctcccggctcacgtacgcccagcaccaggaggaggatgacctgctgaacctgatcgacgcccccagtgttgttgctaaaactgagcaagaggttgacattatattgccccagttctccaagctgacagtcacggacttcttccagaagctgggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatagactatgaatgctatttctagaaaaagtctagtgccaaatttgtcttattaaataaaaacaatgtaggagcagcttttcttctagtttgatgtcatttaagaattactaacacagtggcagtgttagatgaagatgctgtctacaaggtagataatatactgtttgatactcaaaacatttttcattttgtttaaagtagaagttacataattctatattttaagtcttgggtaaaaaagtagttttacattttataaagtaaagatgtaaatgattcaggtttaaagctctatttgacttcctttttttgtttgagatagcgtcttgctgtgttgcccaggctggagtgcagtggtgtgatctcagctcagtgcaacctccgccccctgggatcaagcgattctcctacctcagcctcccaaatagctgggactacaaggtgccctccagcatgcctggctgatttttgtatttttagttgaggtgaggtttcaccatgttggccaggcgggtttcgaaatcctgacctcaaatgatccacccacctcagcctcccaaagtgctgggattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcaaccacctttgggaaagtgtatctgctgctcctagggccatgcttgtatacatatttaaataaacatattcatttacccg

SEQ ID NO: 176104 - DNA, 2378 bp, Homo sapiens
  Payload ID: 14572
  Gene Symbol: RHPN2
  Gene Name: rhophilin, Rho GTPase binding protein 2
  ENST ID: ENST00000588388
  CDS Start-End: 37-423
agtccgccgtccgccctccgcgcccgcgccgctagcatgaccgacgcgctgttgcccgcggccccccagccgctggagaaggagaacgacggctactttcggaagggctgtaatccccttgcacaaaccggccggagtaaattgcagaatcaaagagctgctttgaatcagcagatcctgaaagccgtgcggatgaggaccggagcggaaaaccttctgaaagtggccacaaactcaaaggtgcgggagcaagtgcggctggagctgagcttcgtcaactcagacctgcagatgctcaaggaagagctggaggggctgaacatctcggtgggcgtctatcagaacacagagattttatcctggaacattacagtgaagatggctatttatatgaagatgaaattgcagatcttatggatctgagacaagcttgtcggacgcctagccgggatgaggccggggtggaactgctgatgacatacttcatccagctgggctttgtcgagagtcgattcttcccgcccacacggcagatgggactcctgttcacctggtatgactctctcaccggggttccggtcagccagcagaacctgctgctggagaaggccagtgtcctgttcaacactggggccctctacacccagattgggacccggtgtgatcggcagacgcaggctgggctggagagtgccatagatgcctttcagagagccgcaggggttttaaattacctgaaagacacatttacccatactccaagttacgacatgagccctgccatgctcagcgtgctcgtcaaaatgatgcttgcacaagcccaagaaagcgtgtttgagaaaatcagccttcctgggatccggaatgaattcttcatgctggtgaaggtggctcaggaggctgctaaggtgggagaggtctaccaacagctacacgcagccatgagccaggcgccggtgaaagagaacatcccctactcctgggccagcttagcctgcgtgaaggcccaccactacgcggccctggcccactacttcactgccatcctcctcatcgaccaccaggtgaagccaggcacggatctggaccaccaggagaagtgcctgtcccagctctacgaccacatgccagaggggctgacacccttggccacactgaagaatgatcagcagcgccgacagctggggaagtcccacttgcgcagagccatggctcatcacgaggagtcggtgcgggaggccagcctctgcaagaagctgcggagcattgaggtgctacagaaggtgctgtgtgccgcacaggaacgctcccggctcacgtacgcccagcaccaggaggaggatgacctgctgaacctgatcgacgcccccagtgttgttgctaaaactgagcaagaggttgacattatattgccccagttctccaagctgacagtcacggacttcttccagaagctgggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgt

SEQ ID NO: 176105 - DNA, 4473 bp, Homo sapiens
  Payload ID: 14573
  Gene Symbol: RHOBTB1
  Gene Name: Rho-related BTB domain containing 1
  Uniprot ID: O94844
  ENST ID: ENST00000337910
  CDS Start-End: 339-2429
ggggtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 176106 - DNA, 4339 bp, Homo sapiens
  Payload ID: 14573
  Gene Symbol: RHOBTB1
  Gene Name: Rho-related BTB domain containing 1
  Uniprot ID: O94844
  ENST ID: ENST00000357917
  CDS Start-End: 205-2295
ggcgggacccagagccgccgcgggagcttccagcgtccccaggttttataataatcaagaagcacatgaaagaggcctcttcatcaagcattcttgactaagttatgaaaatggaattgaagtttattttcccccttcatatggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 176107 - DNA, 5451 bp, Homo sapiens
  Payload ID: 14574
  Gene Symbol: RHOBTB2
  Gene Name: Rho-related BTB domain containing 2
  Uniprot ID: Q9BYZ6
  ENST ID: ENST00000251822
  CDS Start-End: 538-2721
atttttttctcctcctttttttaccctcccgtttttttcttttcttttttttttccctatcctttttttgtgaatgaaaaaaggaggtcgcgagcggtacctgggactgcagcgccaggcgtcttcgcggcagcgccttcgccgcgggcccgggcgcgtagcggcggcggcctcgcccctctcccggcgcccctgcgcgccgcccgctgcctccgcagcccggctccgcgcgccgccgtgacattgggcgcctggcgcgcggggcgatgctgatccggaaggggcagcggctgcagtgcagcgcgcgcgtccgctcctgggcccacgtccggcctgggctgccctgccggagtttctgagtggccgcgagctggccgggaggctggagcccagcagcagcgcggcggcgccggcgtcgtcccaacttgcaggcgcggagggacccctgacatttcactaaaatgagcgtgctcagcaggaagagatgtgttcctcacgctagaagccaccccgtcacatgtagtggtgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagtgccccgcccacctcctggaggacccgctctgcgcggacgtcatcctggtgctgcaggagcgggtgcgcatctttgcccacaagatctacctctccacctcttcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctagcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagtgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacacaa

SEQ ID NO: 176108 - DNA, 3505 bp, Homo sapiens
  Payload ID: 14574
  Gene Symbol: RHOBTB2
  Gene Name: Rho-related BTB domain containing 2
  Uniprot ID: Q9BYZ6
  ENST ID: ENST00000519685
  CDS Start-End: 284-2533
gtccttcacctgccttcccataagctggactttggatcccagcccttaaaacccttgtgttgtttcttcctgcagacctggtcgagaacactacttcaggacagggaatagtgacaggccagcagagccccagaggcgaggtggcagtaaacaagaatatgcacgcgcagtggaccacttctgaaggtcaacatataactttctcatccctgacatcaactgtcatccctgtgagcagaaccaactaccaaaggagagaggagcctggagggaacacagagcgatgcaagcctggagaaaaggccccgatggcccccagaagacctcttcagacagcatgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagtgccccgcccacctcctggaggacccgctctgcgcggacgtcatcctggtgctgcaggagcgggtgcgcatctttgcccacaagatctacctctccacctcttcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctagcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaag

SEQ ID NO: 176109 - DNA, 4959 bp, Homo sapiens
  Payload ID: 14574
  Gene Symbol: RHOBTB2
  Gene Name: Rho-related BTB domain containing 2
  Uniprot ID: Q9BYZ6
  ENST ID: ENST00000522948
  CDS Start-End: 32-2236
agaggctgtagtgttccaggagaggggtgccatgaaagcgcggtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagtgccccgcccacctcctggaggacccgctctgcgcggacgtcatcctggtgctgcaggagcgggtgcgcatctttgcccacaagatctacctctccacctcttcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctagcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagtgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttg

SEQ ID NO: 176110 - DNA, 803 bp, Homo sapiens
  Payload ID: 14574
  Gene Symbol: RHOBTB2
  Gene Name: Rho-related BTB domain containing 2
  ENST ID: ENST00000524077
  CDS Start-End: 256-803
cttcctgcagacctggtcgagaacactacttcaggacagggaatagtgacaggccagcagagccccagaggcgaggtggcagcctgttctgttccacgcactcctttatctggaagcagtaaacaagaatatgcacgcgcagtggaccacttctgaaggtcaacatataactttctcatccctgacatcaactgtcatccctgtgagcagaaccaactaccaaaggagagaggagcctggagggaacacagagcgatgcaagcctggagaaaaggccccgatggcccccagaagacctcttcagacagcatgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctag

SEQ ID NO: 176111 - DNA, 5537 bp, Homo sapiens
  Payload ID: 14575
  Gene Symbol: RHOBTB3
  Gene Name: Rho-related BTB domain containing 3
  Uniprot ID: O94955
  ENST ID: ENST00000379982
  CDS Start-End: 509-2344
ccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaacctggagcttttatacactacatttcttttttattattatgaagaatgggatacctccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaa

SEQ ID NO: 176112 - DNA, 693 bp, Homo sapiens
  Payload ID: 14575
  Gene Symbol: RHOBTB3
  Gene Name: Rho-related BTB domain containing 3
  ENST ID: ENST00000502541
  CDS Start-End: 1-310
tgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatc

SEQ ID NO: 176113 - DNA, 883 bp, Homo sapiens
  Payload ID: 14575
  Gene Symbol: RHOBTB3
  Gene Name: Rho-related BTB domain containing 3
  ENST ID: ENST00000504179
  CDS Start-End: 83-811
aagactcatagggtttcaggaccttgcagcttctcagcaatggagctgagttttcacttaggcaatttgtttactgctgtgaatgccaaagagagcagtgttgttcactgacaggcagcccatacagttcttaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaacctggagcttttatacactacatttcttttttattattatgaagaatgggatacctccaggttccagtaaaa

SEQ ID NO: 176114 - DNA, 333 bp, Homo sapiens
  Payload ID: 14575
  Gene Symbol: RHOBTB3
  Gene Name: Rho-related BTB domain containing 3
  ENST ID: ENST00000510623
  CDS Start-End: 1-219
ctggtctccggggacgagagcagcttgttgctgaacgcggccagcacggtcgcgcgtccggtgttcaccgagtatcaggccagtgcgtttgggaatgtcaagctggtggtccacgactgtcccgtctggaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaa

SEQ ID NO: 176115 - DNA, 547 bp, Homo sapiens
  Payload ID: 14575
  Gene Symbol: RHOBTB3
  Gene Name: Rho-related BTB domain containing 3
  ENST ID: ENST00000506959
  CDS Start-End: 6-547
gacaaatgagaaagcggcagacgtggtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaact

SEQ ID NO: 176116 - DNA, 496 bp, Homo sapiens
  Payload ID: 14575
  Gene Symbol: RHOBTB3
  Gene Name: Rho-related BTB domain containing 3
  ENST ID: ENST00000514198
  CDS Start-End: 1-112
catcttcagtcaaaagcctgaatttcaggatctttcagtctttttcttaaaacttcagtggaagaacgcagttttgttgaaaagcacagatggccgtcgaatatgtacttgaagcagcttgcggaatacaggaagtatattcactcccggaaatgtcgttgcttagtaatgtaacctggagcttttatacactacatttcttttttattattatgaagaatgggatacctccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaa

SEQ ID NO: 176117 - DNA, 990 bp, Homo sapiens
  Payload ID: 14575
  Gene Symbol: RHOBTB3
  Gene Name: Rho-related BTB domain containing 3
  ENST ID: ENST00000510313
  CDS Start-End: 1-518
ttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcaggtagattgctaatttctgttttgaaaagaaaactttatgttctttgttcttagatttgagacataagttgtagaagtagtacttttagcaaaataagaatagtcaatgtaataaatttcttgtaaattatgcagtgtggtaattgaggaaacaatttatagtcacctgtgttacataagtgccttaacctgtgttacacaagaagttttctaatgattattttatagctccatccgtttttaaatgcattttctttccctgaaatagataaggtgacaaaatgtgtcctcaggtgacatttggttgtgaaaagtgatatcttagttctaactacctaagtcagcagcaaagtttaaacagtacagatttaaaaattttttataaaggaatttaactcttgttaactatattatatttagctttattgtactggatatctgtatttactgagtatacctatatgggagtcccttatattactttggaataacagtttttcatatataaaaaatgttgtgaaactta

SEQ ID NO: 176118 - DNA, 591 bp, Homo sapiens
  Payload ID: 14575
  Gene Symbol: RHOBTB3
  Gene Name: Rho-related BTB domain containing 3
  ENST ID: ENST00000513091
  CDS Start-End: 1-229
ctacctcatcttcagtcaaaagcctgaatttcaggatctttcaggaagttttatggtgaaaccagagtatcttcaaagaggcggggccaaggccagagctggacaccacgactgccacgtaagaggaatcccaagcatactgcgatcaagggaagggaagaaaatccactcccagaagcagctttttactgtgactctcatcgttactagaattaaaatggcaaaatgagaaagccagattctgagtcacggagggggagctaagtgacagctctgtccagagaaaaggatgtggcagggctgggaggcccctcacgtggtcagggctccggacttcccacttcccacttccctccaaagtaggctctgccacagagtctgagcctcctctcttttttcattcttttacctcagaaccctgtggccaggctccttccagaggcccctgccaggaggtccagggtctgtttcagggccctcaggctgttgccttaagttccctcagcctgaggtttatccacacgacttgcacctgctactcactcagagcctttctcttctccggtctgttgttggctcctcccttcctgg

SEQ ID NO: 176119 - DNA, 653 bp, Homo sapiens
  Payload ID: 14575
  Gene Symbol: RHOBTB3
  Gene Name: Rho-related BTB domain containing 3
  ENST ID: ENST00000503737
  CDS Start-End: 1-352
cgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaataaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaa

SEQ ID NO: 176120 - DNA, 1432 bp, Homo sapiens
  Payload ID: 14575
  Gene Symbol: RHOBTB3
  Gene Name: Rho-related BTB domain containing 3
  ENST ID: ENST00000506817
  CDS Start-End: 538-852
cgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggtaaggaagagcagctgctccgcgctgaggctgaagaagcttttctttccttttttttccccctcccccttctgcccacttccgtgagtgtggagtgtccgcgttacatgggtcaaatttttaaacatttttgagaaaatctttggtcctttgtttcactgggcagggaacagccctgtcagagaacactcttaggaagatagaaggccccagtgggaatgtggagcacttactggtacacttcacgactgtgggttgacccttggtaggcagcagacagttgaatgtgccaactccaagggacggggtcactaagtttcatcagcaaaaagcagtgtttttttatgtctaccctatgggtgatagtgtaatattggtgttctaaaaatacatccctctcaaagctcaacacaggcaaaaatacttttcactgggacagttcagaaatagttcctctggaaagcggaggaaaagacagggactgggagttaattttaaatgactcatttatagcactattaattgatctctgaaaacttaattttaataatgcaaatactctttatgtgttagccatttgtcttagtgactcataaatcagaaataacattactaatgttgtttggaaaacttttaaaaaattaaaatttgtaataattgaacaaaa

SEQ ID NO: 176121 - DNA, 2220 bp, Homo sapiens
  Payload ID: 14576
  Gene Symbol: RTKN
  Gene Name: rhotekin
  Uniprot ID: Q9BST9
  ENST ID: ENST00000233330
  CDS Start-End: 319-1860
ggaggggcctgtgagctggggccgcccctgggattagcccggccttcggggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagca

SEQ ID NO: 176122 - DNA, 2142 bp, Homo sapiens
  Payload ID: 14576
  Gene Symbol: RTKN
  Gene Name: rhotekin
  Uniprot ID: Q9BST9
  ENST ID: ENST00000272430
  CDS Start-End: 84-1775
cgagagacagaagccgaggagaggaggctaagccgggcggcgcggggagcgcactgagcaggcaaagtcgcagggccgccagcatgttctcccgaaaccaccggagccgggtcaccgtggccaggggctccgccctggagatggagttcaaacgcggccgcttccgactcagcctcttcagcgacctgcccgaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttca

SEQ ID NO: 176123 - DNA, 2646 bp, Homo sapiens
  Payload ID: 14576
  Gene Symbol: RTKN
  Gene Name: rhotekin
  Uniprot ID: Q9BST9
  ENST ID: ENST00000305557
  CDS Start-End: 587-2239
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggacagggtgcctctctctgcctggtct

SEQ ID NO: 176124 - DNA, 2383 bp, Homo sapiens
  Payload ID: 14577
  Gene Symbol: RTKN2
  Gene Name: rhotekin 2
  ENST ID: ENST00000315289
  CDS Start-End: 170-1096
taatgaagcagggccagactttcagataaaggtggaagtgtatagttgctgtacagaagaatcttctataaccaacacaccaaaaaagctagctaagaaactcaagacatctataagtaaagctacaggaaagaaaataagttcagtgcttcaagaagaggatgatgaaatgtgcttgctcctcagctctgctgtttttggtgtaaagtataatttgctagctcacactaccctaaccttggaaagtgctgaggatagtttcaagacccataatctgtctattaatggaaatgaggagtcttcattttggcttcccctgtatggcaacatgtgctgccgactagttgcccagccagcttgtatggctgaggatgcatttgcaggatttcttaatcagcagcaaatggtagaaggtctgattagttggagaaggttgtattgtgttttgcgaggaggtaaactctattgtttttacagtccagaggaaattgaagctaaagtggaaccagctttggtagtacccattaacaagtcattagttttatttgaagacagtctcgaaggaattcaactcgccatatctcagtcctttaaggaaaccagaatccgggcaatggataaggatgccaagaaaagaatccataatttctctgtcatcaatcctgttcctggacaagctataactcagatttttgcagttgacaatagagaagatcttcagaagtggatggaagccttctggcagcatttctttgatcttagccaatggaagcactgttgtgaagaacttatgaaaattgagattatgtcaccacggaaaccacctttgttcttgacaaaagaggcaacctcagtctaccatgatatgagcattgattcacctatgaaacttgaaagtttaacggatataatacaaaaaaaaattgaagagacaaatgggcagttccttattggtcagcatgaagaatccttaccacctccttgggccacactctttgatggtaaccatcaaatggtcatccagaaaaagaataatagtaatcaactacataatctccagaaactgccagcaacttccaaattcctcttcacatagcttctcaaatacttcattagaaccagtgtgaaaaatttaaaatacaatgtgacatttctctagtagaatgtaagcttcatgagggaaaagacaacgcgtctccttcctgtattcctagcacccagtacggcacctgacacataatagtgaccttagaagaatatttaagagtcattgagtaaacattttgtagagctgtccatgtttattttccattcagtgtttaccaggtgtctgctatttggacagtcacttcattgttcattagtacatgactttggtaaatatatctcctgtgaagagaaatattataactactatggcattcaacactggtatttcagttactcaactaatccacccactgatggagtgaaccttgaattaaatgctttgaagaataaagtgaatcttgataaaaatcaaaggctgaagaaatcttgtttgacagaaggcatgaacaaaaatgctaaaattaatactgtttgtggagaaacactcattccaccgcagactaaatggagttcatgagtatcaaaatgcctatgtgatcaaaaggcagaaacagcttctttttactaggtctgttaatattccaggactcataatattgtgcctacatgagcacctgtgtttgtggtaactcaaagtatttgaacaccttatctcatccaacctcaaatttcctgtgaggtatttaagcaccgagagctcttggtactgttttcaagatgaagcagatgaattagagaggctgttcacacaccaaatttcacagaagcctatggaggaaatgacggggagacttaccagttaacacccagttgcagaaatcaatgtcagagcttgaaaggaccttataaacccctgatccaatgtggactttcctagtaagacttctgtttgcagtgacttggttcatttcaccaaccacaagaattttaagtaatttttaatcataaaagtaacatagaacatagtaatacatatatacgtacatacatgatacagaaaggtatcaaaaaacaaaaacatatattacttcctcctctaacattccagtgccagtttccaaagattcctattacccagaggtaaccactgttaataatttttaatgtatatttccaaaaattttttatgcatttagaaatgtgtgcatgtgggtgatgggtgcaccaaaatctcagaaatcaccactaaagaacttactcatgtaaccaaacaccatgtggtcccccaaaaacctattgaaataaataaataataacataataaagacttaat

SEQ ID NO: 176125 - DNA, 6641 bp, Homo sapiens
  Payload ID: 14577
  Gene Symbol: RTKN2
  Gene Name: rhotekin 2
  Uniprot ID: Q8IZC4
  ENST ID: ENST00000373789
  CDS Start-End: 98-1927
ccgggcggttggcgtcctctgcggctcctgccaggggcgggcttttcaaatcttccctttgaaggagtggcgacggcccggacagttcgcgttggagatggaggggccgagcctgaggggtcctgcgctccgcctggcggggcttcccacccagcaggactgcaacattcaagaaaaaatagacttagaaattcgaatgcgagaaggaatatggaaactcctttctctgagcactcagaaagatcaagttttacatgcagttaagaatctcatggtgtgcaatgctcgactaatggcctatacatcggagctacagaaattagaagaacagattgcaaatcagactggaagatgtgatgtgaaatttgaaagtaaagaacgaacagcatgtaaaggaaagattgccatatcagatattcgaataccactaatgtggaaagactctgatcacttcagcaataaagaacgatcacgacgctatgccattttttgtttattcaaaatgggagctaatgtgtttgatactgatgtggtgaatgtggataaaacaatcacagatatatgttttgaaaatgtaaccatatttaatgaagcagggccagactttcagataaaggtggaagtgtatagttgctgtacagaagaatcttctataaccaacacaccaaaaaagctagctaagaaactcaagacatctataagtaaagctacaggaaagaaaataagttcagtgcttcaagaagaggatgatgaaatgtgcttgctcctcagctctgctgtttttggtgtaaagtataatttgctagctcacactaccctaaccttggaaagtgctgaggatagtttcaagacccataatctgtctattaatggaaatgaggagtcttcattttggcttcccctgtatggcaacatgtgctgccgactagttgcccagccagcttgtatggctgaggatgcatttgcaggatttcttaatcagcagcaaatggtagaaggtctgattagttggagaaggttgtattgtgttttgcgaggaggtaaactctattgtttttacagtccagaggaaattgaagctaaagtggaaccagctttggtagtacccattaacaaggaaaccagaatccgggcaatggataaggatgccaagaaaagaatccataatttctctgtcatcaatcctgttcctggacaagctataactcagatttttgcagttgacaatagagaagatcttcagaagtggatggaagccttctggcagcatttctttgatcttagccaatggaagcactgttgtgaagaacttatgaaaattgagattatgtcaccacggaaaccacctttgttcttgacaaaagaggcaacctcagtctaccatgatatgagcattgattcacctatgaaacttgaaagtttaacggatataatacaaaaaaaaattgaagagacaaatgggcagttccttattggtcagcatgaagaatccttaccacctccttgggccacactctttgatggtaaccatcaaatggtcatccagaaaaaggtactgtatcctgcaagtgagccattacatgatgaaaaagggaaaaagagacaagctccccttcctccttctgataaacttccattcagcttaaaatcacagagtaacacagatcaattggttaaggacaactggggaaaaacaagtgtatctcagacatcgtctttggataccaaactatcaactctaatgcatcacttacagaaaccaatggctgctcctcgaaaacttctgcctgccaggagaaatagattaagtgatggtgagcacacagacactaaaaccaattttgaagccaagccagtgccagctccaaggcagaaatccatcaaagacattctggaccctagatcatggctgcaggcacaagtatagaaaactcttaatgataaaacatttaacaaaatctataactgtgaagcttaattcagaggcattatagaataatgtgtaattatataggtaaatatagtgatttataccaataattaataagctattaggtatagaaaaacattttataatgaagaagtggatttctcttttactcctgatttgcagaatgtaagtgatttctccagcagtgtgcaagaggcagtttctagacaatatcctaattgttggaagggttaatttattcctgaattagtaccaggcagtgaataagccctaggcagaataaagcattaaaatttcttttggggagagactgtctagtaatttaaaatgtgttaaatatgaaccatattctcattgtgagaattttaatactaatggaatgtttcaaaggttttattcaaaccacaaattatagaatccacccaagaaaattttcttagcattctggaattctcatctaatggttcactggctctcatctattgtttaactcactagtttataggcctgaccttttaaattcctgggataaattttagaatattaaattcttcatctttaaagggaatttgtaatgtgctattcaaacttgtttccttgatgagccctgaaatactgttgacattaactttcataaatgaagcataacacttactagtttagagaaatggtagatgaaatgctctttacattcaattttctgtgtgtggtgctaatttccattgtgactttggaatttagggaagtgagtagctgatcaacaccttaaaattcatttaatacttatttaaaaagaagatgagagattcaaaaatatcagaaaagttggccatggtaaataattttcagaattcttttttaaaattttaattagatttccttttcctagtaagagttgatgtctgctagtggtatttttcattaaatgtcatattcttacaacagtgacattggaatcatttccataggaggtaatttccatagcaactaatcatagtgacccaaacaggattataaagtcaagtgaggaataaatagcagaaaaataccttaaaggaacaaaaaatccattttttataataatgctttttgtaaacaagagcagaacagttttaaaaatctaattagaatttccaaataaaacagtttccataaggtgtcagcaacagcactaaaaatctcaaatcacactgaaccctaaatgtcattgcaagaaataaaaatttaagaattaaattgctgccctgtgtataatctcttgagatctttttaaagctagcaagaactctatttggatcagaactacattattacaaaacaaaatgaacacttgaccaaaaaaccacattaatttaaatggagcctttcattattttcagatagcggggtcttttccatttatagagaatgatgtaactgccaggacacttttgtgtttgcccaggactcctagtaagaattgaatcttgagggagtaatgataacaaaaggtttcttgtgactggtaacatcaggacagacagagtttttggtgagaagaaagtactatatgcctgcttgatagcatgtagagatcatcacatgtatggaaaccttaaaaagtaaacttattttttctaactagaaggctctcataagtttctgttatgattgccatttcaataaatgacattaaaaatctaaaggatattattgtttgaatttttgggttattttttaaaacttcattgctgtttttgacagcatttgtgactgtcattgccactaaattattgagctagaagatgctgcagggaaaattgttttgaagctggcatctaagcattcttttttttttcctagttgatgccttcctttattacaaatcagtattaaaacttccagattatattcttgtcatttttcctcatgcagataacagcaggaaggacttaaggtgtataagaaaaagaaagtattcatacagaaattacctagcagttgtgccctcagagtagaactttgaaacaggactgaagccctttttacctagaaccatttaaaagcctgagcaaggaccaccaccccctccccaccaaattattcggtctctttctggggggcccagcttactgtatgttacaagtctttgaaatgggtctggtgtcttcagctcctgaaatgctaatttaccccttacctaaggagtgtagttataatacagagttggtttccttccttccttccttccttccttccttccttccttccttccttccttccttccttccttccttcattccctctgtccgtctctccttccctccttccctccttccttcctttttgtctttgtttctttctctggccccctgtcctctctctctgtctcatccccttttcccactttccttctgtctctccttcctcccttcctttacagtttaaaaaaaaaatctaaaaatagttaagcactgtgtcaaagagtgtttcaaaagaattgtttgttttctcatttcttaaaccagaagtttatgacaaataaatatgccatgtaatatgaaagctgcttcagctttttatgagctttcacattccttgtttgtccttttaatttgtttcttgatatatgaagactataaacttgaaacaaagagttagctgtcagctcttgataatataattggggaaacagaatagatattttatgatatgataattctgatgatctaaagataatgtcttagacaattacctttacatttcaagctctgggatataaattacgtagtcagcattaagatagtattatttttaattgctactaagtggtaacttttgtattttaatatcttgcaagggcaaagaaggcatttttaaaattctaaatgcacacctcctaaggtaaatagtctttcaaaaatatcaggcgtgccaactcttgctgagttttgttaaatcctccttaactgtctgcagtgccccctgacttcttttaaatggatgtgaatatatgtggaaaactaaatccatttattataaatgccttatctttaccctttgggatcttactaaatgcattttacctgctactatttattaaaaatggaagctgtcttgaattagagatacctcacgtaaggtaggttaagcagtcaagtatttctttaggcttatgttcagcacctcagccccctactgagaagttaattaattcagtccaaaatgaaattatagggcagtttggtgcaatttatgttaaatgccatttgaatgtaatcacctgtgttaccacgaatgaggcacaactatactacatggacagagtactgcattgcaccatgagcaagaactgctctgcaagaaaaatatctgtccctgtggtctgaatttatcaaaactcattttcttgttaaagagtgaattattgaatagtaattaaactttaactgatgaccatttatattctagtagccatcttcactgttagtcttaaattataatgtaaagttgacattttccccttacatttcaaaggcatcactatttttaaatgtttacatatgtttacatgtttgtgtgcaactgcttcattgctattaatagttaaatgaaatctgcatattctggatcatagatgttcttagttaactctgggaaagatgttacctttgggtttttaaaagacaagtcatcatttgaaaatatattagggtgtgttgattttctgacatgcttgtgtaattggctttgtttataatttttattttttaatatgggtcagacttttggattaaaaagtattatatcatggacatacattttttaaagtaccaaaggtatttggtaagcgagcccaagtcatgtaattgaaacttctgtacattaaaagaactgattcatgaagacgttttctaactttttctctttaagtgctcctctagactagactgattgaagtagacagtgtggtggaatcagtttaatcagaaaaagacataccaagtagctggtgctaattattataagactaacattctgataagccatggtataattaacattattaaaatgtttacatataatccttcttaaagtatactcttttaaaaatccattgacataaccttacttttagtttagtgatccagaatttccccagagcttaagccactgcagtaaattaggtacgtaggatattcagtcgctactagccacaaggagtctccttattttaatgtacctccctcagtactttattcctgcagagcgcctcagagtgggggagagaaatgagcaatcctggctcagttggattatttcagcattttatttctaaatctgtagtgtgatcagaaatatttaaaattaaaaaaatactttacagagagaggcctactaatcaatgtgcttagagaaacaaactacctttacattcaattaacaacaaaaaaagttacagaaattttaacaaacatttttctttatctgagtatgggagaaaatactaatgctgacacgtttaataattagaaaagatcattccagatcttatggaaaattgtgttttaaattccagcagtttgctcttgagacatggtaatctcttaatgtaactactaaaggagaggtagattgaaaagatcttgtatatacataattatgtcagatggttcaagatatcaaaataaattgttttgttgaaaatgaa

SEQ ID NO: 176126 - DNA, 2076 bp, Homo sapiens
  Payload ID: 14577
  Gene Symbol: RTKN2
  Gene Name: rhotekin 2
  Uniprot ID: Q8IZC4
  ENST ID: ENST00000395260
  CDS Start-End: 98-589
ccgggcggttggcgtcctctgcggctcctgccaggggcgggcttttcaaatcttccctttgaaggagtggcgacggcccggacagttcgcgttggagatggaggggccgagcctgaggggtcctgcgctccgcctggcggggcttcccacccagcaggactgcaacattcaagaaaaaatagacttagaaattcgaatgcgagaaggaatatggaaactcctttctctgagcactcagaaagatcaagttttacatgcagttaagaatctcatggtgtgcaatgctcgactaatggcctatacatcggagctacagaaattagaagaacagattgcaaatcagactggaagatgtgatgtgaaatttgaaagtaaagaacgaacagcatgtaaaggaaagattgccatatcagatattcgaataccactaatgtggaaagactctgatcacttcagcaataaagaacgatcacgacgctatgccattttttgtttattcaaaatgggagctaatgtgtttgatactgatgtggtgaatgtggataaaacaatcacagatatatgttttgaaaatgtaaccatattgtaagtattttttaatcttcagagaataaaaataatttaaaattcttcttttttaaaagaaagttcttattattggttctttggattcattttatgtttaaatgtttaagtgatctttaaatgtttaatatgattttaaaaatcattttgttcagaagaagtccatttctctatctgcagttttctgatgtgaaataaaaatggaaatcttgtaattactattagcagtaaatatttgacttattagatatgacccatttttaaattgttaataaatatagttcagttattaacaaagctatgcatacaacagaatatcctgtaatgttatttgatatagagagaatttaagcataaaacaggatttttatctcatgtaggatatttggttgcagaaatactaaaatagtatagcaactttatttacaagatagtcctgaagtacatgctatataggaagagcactttgaaattttggggtgttctttttcttatggtgcacttctttcatgtacttcaaagcaataaaaaaaaatgggtgatctcagggctgtttttattgtccctgctcttttacaggctcattttattgtggtcataatacagaacaagaaggaactccttgggtagccatagaaatcatttttaactaacatagtttttcctgccctccttcaaaggttctatgtgcctaaatcagtgtgggatttgtattttagacttttaaagacacgatctttagatctaaatgttaatagctactaactattaatataaaaatccatgtgcatggtttttgccattttcagctatggagctagacaggtgagattttagaggcctagttttgccactcacataacattaaaaaaacctatagtaaaccatattttgtagcttctggtccagtgtctcatagtaatagtatagcctggaaaaataaaatgcattgttctgagttataagtagtaattcaggccttcttacaagctgtattgaaccaaaggaatttatttaggatccaaaacatatccccaaatgcttatataattgaggctaaaaaaattacttttttcttggttatctgaatacatttatttccattatcaactattgctagtgaacttttttttctgccaaaattaccagttgatgggcccttttcttcacatcattttgctattgtttgttttgatcatggagacaaaaatcagacttttttttccagggaaagaacaatagaagttactgaggaagacaacacatgatttataattttttgagaattctgtaaatattttaaattgtactaaaaataactgctgacaaatgttctacatgttgaaaaatgtgctttttgttatgatgattgtttttaataagtattcaatatttatgaatctctggtttttctctaaatattgacatttgttagtcattaccaggaatactgcatgtttaaaagttgccaaataataaactataaaaata

SEQ ID NO: 176127 - DNA, 769 bp, Homo sapiens
  Payload ID: 14578
  Gene Symbol: RHOXF1
  Gene Name: Rhox homeobox family, member 1
  Uniprot ID: Q8NHV9
  ENST ID: ENST00000217999
  CDS Start-End: 76-630
aactagctccaccctctaacccccactccagctgcagacgccacggagtttgtgcaggggcgcagcgctccagccatggcgcgttcgctcgtccacgacaccgtgttctactgcctgagtgtataccaggtaaaaataagccccacacctcagctgggggcagcatcaagcgcagaaggccatgttggccaaggagctccaggcctcatgggtaatatgaaccctgagggcggtgtgaaccacgagaacggcatgaaccgcgatggcggcatgatccccgagggcggcggtggaaaccaggagcctcggcagcagccgcagcccccgccggaggagccggcccaggcggccatggagggtccgcagcccgagaacatgcagccacgaactcggcgcacgaagttcacgctgttgcaggtggaggagctggaaagtgttttccgacacactcaataccctgatgtgcccacaagaagggaacttgccgaaaacttaggtgtgactgaagacaaagtgcgggtttggtttaagaataaaagggccagatgtaggcgacatcagagagaattaatgctcgccaatgaactacgtgctgacccagacgactgtgtctacatcgtcgtggactagccctagaatgccatccttcttcaggagctagtttggagatgggtttttctggtgccactgacacctgggctgcccatgccgctcaggctacccttatctcctctgcacttatgttatcaataaagaggcaaattctcaa

SEQ ID NO: 176128 - DNA, 2900 bp, Homo sapiens
  Payload ID: 14579
  Gene Symbol: RHOXF2
  Gene Name: Rhox homeobox family, member 2
  Uniprot ID: Q9BQY4
  ENST ID: ENST00000371388
  CDS Start-End: 191-1057
aacccacagcaaatagcgggaagcagaaaagcaagagaggaggtctctaagtggatacactgttgctgagtctagacaccagaagaacgttgcaggcggcgactcacagttctagcactgcctaggagagcgtggtggccccagctcagaatctgcagaagtgcacagctccatccacaccactcagggtatggagcctccggaccagtgtagccagtatatgaccagcttgctcagccctgcagtcgacgacgagaaagaactacaggatatgaatgctatggtgctgtcgcttactgaagaggtcaaagaggaggaagaggatgcacagcctgagcctgagcaaggcacagcagcaggagaaaagttaaagtcggcaggagcccaaggcggagaagaaaaagatggcggcggagaagaaaaagatggcggcggcgccggagttcctggccacctatgggaaggagacctcgagggcaccagcggcagcgatggcaacgttgaggacagcgaccagagcgagaaggaacctgggcagcagtattcgcgcccacagggcgccgtcggggggctggagcctggcaacgcgcagcagcccaacgtccacgccttcaccccattgcagctgcaggagctggagcgcattttccaacgcgagcagttccccagtgagttcctgcgaaggaggctggcaagaagcatgaatgtgactgaactcgcagtgcagatttggtttgagaatagaagagccaaatggaggagacatcagagggcattaatggcaagaaacatgctgcccttcatggcagtgggccagcctgtcatggtaaccgcagctgaggccataacggcacccttgttcatcagcgggatgagagatgattacttctgggaccacagccattccagcagcctgtgtttccccatgccaccctttcctcctccgtccttgccccttccactcatgcttcttccacctatgccacccgctggccaggctgaatttggcccattcccttttgttatcgtgccttctttcacattccccaatgtctaagggatagcctctgtgccactttttgccagagtgtctttgagccagattcatattttgcatagcaccccatcaaaagtagttcatcaaatgtctattaaacgttttaaagaaaagtacatcattgacccatttttagggcacttgtaaaaatgtttctataaatatgtgaagggtatgtacatttgttttgtgtgtcacatggggtcagtaagttctcaataaaaattgttaagaaatgccattcaaaccgaatgtcacggactctcgtctcatgcagtaatcttgagtcaccatctgggggctgtgcatgtcacagaattttcccatgtgcccatggcaggcttacaccgacccagacattctcttccacccccacccccaacaccccatactcatctcctctctgcccccattgataccaggtacatgtgcaggatggggtggtgtgagtccctaatgagagaatagtgtgtttcaagttactgccagggtggaaaacagcaaaaccaaaatggtatcgggaaggaagccatgcccactcttaaaaattcattaagttttttcttgctatggaagacttctttaaagtaattttcttgtaaaagtgtaagtgtaaataatgccatgaaattatacacttatttaatggctaaaatggcaaatttttatatggtttaccacaacaaaagaaaagaaaaaatataccaaaaagtttttaaaaagtgatcatgaacattgtggtcatcctgtgaagtgattgcaatgcctgcagataaggagtgatggttacaacagtattttctctgaaaattatttgatggccagtttcataatgattatgttttcagcctgaaggaaaattccattttcttgggtgagcatgaactttctgtcaggctgtctgctgcttttcattccccacttctctcttcacaattgtgggtgtcaagcttcagccacgcaattgcatttggtgtgagggttttgcaaggagaaggaggtttattcatacccctgaagccacaagccttggtgggaataaggaaagtccatgaattcactatgcattaatgcatgcctcttggccaagtggattcttttttcttctccgattgagattttccttttttttttttttttttttttttgctcttgttctcattgtattgtgctttgtataattatttacagtaagtcgcgcatgtcagtgtacattccgtctggaaattgtttccatttggtacattttgtgccagtcggtctattcctgctcattattttgttttttctacattcagactgaaacatttggtagcctagagatactcagaaataggcaaagaaaggtaaaaggggaggaggggagattgaaatcatacttccattatccctccccgtggttatcagattcataaaatttttacaccatcaaaagacatttttagccatatatgtttcctttatgtagaaaatgagatctcctatactcagttggcatttgttttcatgtatctgataagtacctgttagaattataggtcaagatgttgtctagctctggtaacctagatcctgaacttcaaagcagagttcttggaccttaagaaattcaaattcgtagaattatagttaggatgtcatttactgaccttgaacaacacattgtttaggtagcatacaatgggactagttcaaggggctgggtggagaacaagttacaattttttctgatggagaacattactggagacagtaccctttaaaactttcattccctttttattagcagctaacgtcttgtatgcctttactatgtgacaagcaataaaataatgtccttgga

SEQ ID NO: 176129 - DNA, 2864 bp, Homo sapiens
  Payload ID: 14580
  Gene Symbol: RHOXF2B
  Gene Name: Rhox homeobox family, member 2B
  Uniprot ID: P0C7M4
  ENST ID: ENST00000371402
  CDS Start-End: 154-1020
aggaggtctctaagtggatacactgttgctgagtctagacaccagaagaacgttgcaggcggcgactcacagttctagcactgcctaggagagcgtggtggccccagctcagaatctgcagaagtgcacagctccatccacaccactcagggtatggagcctccggaccagtgtagccagtatatgaccagcttgctcagccctgcagtcgacgacgagaaagaactacaggatatgaatgctatggtgctgtcgcttactgaagaggtcaaagaggaggaagaggatgcacagcctgagcctgagcaaggcacagcagcaggagaaaagttaaagtcggcaggagcccaaggcggagaagaaaaagatggcggcggagaagaaaaagatggcggcggcgccggagttcctggccacctatgggaaggaaacctcgagggcaccagcggcagcgatggcaacgttgaggacagcgaccagagcgagaaggaacctgggcagcagtattcgcgcccacagggcgccgtcggggggctggagcctggcaacgcgcagcagcccaacgtccacgccttcaccccattgcagctgcaggagctggagtgcattttccaacgcgagcagttccccagtgagttcctgcgaaggaggctggcaagaagcatgaatgtgactgaactcgcagtgcagatttggtttgagaatagaagagccaaatggaggagacatcagagggcattaatggcaagaaacatgctgcccttcatggcagtgggccagcctgtcatggtaaccgcagctgaggccataacggcacccttgttcatcagcgggatgagagatgattacttctgggaccacagccattccagcagcctgtgtttccccatgccaccctttcctcctccgtccttgccccttccactcatgcttcttccacctatgccacccgctggccaggctgaatttggcccattcccttttgttatcgtgccttctttcacattccccaatgtctaagggatagcctctgtgccactttttgccagagtgtctttgagccagattcatattttgcatagcaccccatcaaaagtagttcatcaaatgtctattaaacgttttaaagaaaagtacatcattgacccatttttagggcacttgtaaaaatgtttctataaatatgtgaagggtatgtacatttgttttgtgtgtcacatggggtcagtaagttctcaataaaaattgttaagaaatgccattcaaaccgaatgtcacggactctcgtctcatgcagtaatcttgagtcaccatctgggggctgtgcatgtcacagaattttcccatgtgcccatggcaggcttacaccgacccagacattctcttccacccccacccccaacaccccatactcatctcctctctgcccccattgataccaggtacatgtgcaggatggggtggtgtgagtccctaatgagagaatagtgtgtttcaagttactgccagggtggaaaacagcaaaaccaaaatggtatcgggaaggaagccatgcccactcttaaaaattcattaagttttttcttgctatggaagacttctttaaagtaattttcttgtaaaagtgtaagtgtaaataatgccatgaaattatacacttatttaatggctaaaatggcaaatttttatatggtttaccacaacaaaagaaaagaaaaaatataccaaaaagtttttaaaaagtgatcatgaacattgtggtcatcctgtgaagtgattgcaatgcctgcagataaggagtgatggttacaacagtattttctctgaaaattatttgatggccagtttcataatgattatgttttcagcctgaaggaaaattccattttcttgggtgagcatgaactttctgtcaggctgtctgctgcttttcattccccacttctctcttcacaattgtgggtgtcaagcttcagccacgcaattgcatttggtgtgagggttttgcaaggagaaggaggtttattcatacccctgaagccacaagccttggtgggaataaggaaagtccatgaattcactatgcattaatgcatgcctcttggccaagtggattcttttttcttctccgattgagattttcctttttttttttttttttttttttttgctcttgttctcattgtattgtgctttgtataattatttacagtaagtcgcgcatgtcagtgtacattccgtctggaaattgtttccatttggtacattttgtgccagtcggtctattcctgctcattattttgttttttctacattcagactgaaacatttggtagcctacagatactcagaaataggcaaagaaaggtaaaaggggaggaggggagattgaagtcatacttccattatccctccccgtggttatcagattcataaaatttttacaccatcaaaagacatttttagccatatatgtttcctttatgtagaaaatgagatctcctatactcagttggcatttgttttcatgtatctgataagtacctgttagaattataggtcaagatgttgtctagctctggtaacctagatcctgaacttcaaagcagagttcttggaccttaagaaattcaaatttgtagaattatagttaggatgtcatttactgaccttgaacaacacattgtttaggtagcatacaatgggactagttcaaggggctgggtggagaacaagttacaattttttctgatggagaacattactggagacagtaccctttaaaactttcattccctttttattagcagctaacgtcttgtatgcctttactatgtgacaagcaataaaataatgtccttgga

SEQ ID NO: 176130 - DNA, 864 bp, Homo sapiens
  Payload ID: 14581
  Gene Symbol: RIBC1
  Gene Name: RIB43A domain with coiled-coils 1
  ENST ID: ENST00000329209
  CDS Start-End: 321-864
cgggcgaccggcaaatgtcgcgagaatacgtccaggcctaacgggattttcgccttccggcaggagtgggaccaggggcggggactgatgttgcgtatacgaggagcgagctgacgactggcgtggtgcctccgcccccctttcttgttgcatggcaacaacaaacacttgctcctgcggaccagatccccggaggagttgttgctgggcggagtcagagcagttcttgagagttcagaaactgccgccgtaacccaagaacaaagttgcatgcagagccaacctaagagcttcaaaatcgggattccttactgagaaagatgtataacataaaacagtcaacagataccaaggaagcagcagccatcgaggctagaagaaatcgagaaaaagagcgacaaaaccgattcttcaatgtgcggaaccgagtcatgggggtggatgtccaggccctgaacaaccaggtgggagaccgaaagcgtcgggaagcagcagaaagaagcaaggaggcagcttatggtaccagccaggtgcagtatgatgtggtagtccagatgttagagaaggaagaggcagatcgaacacgtcagctggccaagaaagtccaggagtttcgggagcagaagcagcagctcaagaacgggcgtgaatttagtctttgggatccaggccaagtctggaaggggcttccaacctatcttagttacagtaatacctatcctggtccagccagcctgcagtacttctctggggaagacctagacagggacacacggctgagaatgcagcaggggcagttcaggtacaacttggaaaggcaacagcaggagcaacagcaagccaaggttgatgagaattatacag

SEQ ID NO: 176131 - DNA, 1420 bp, Homo sapiens
  Payload ID: 14581
  Gene Symbol: RIBC1
  Gene Name: RIB43A domain with coiled-coils 1
  Uniprot ID: Q8N443
  ENST ID: ENST00000375327
  CDS Start-End: 154-1293
cctgagctcacgcttgctgagacagaagtcacagcaggattatgcccctcagggcaagaggaagagttcagaaactgccgccgtaacccaagaacaaagttgcatgcagagccaacctaagagcttcaaaatcgggattccttactgagaaagatgtataacataaaacagtcaacagataccaaggaagcagcagccatcgaggctagaagaaatcgagaaaaagagcgacaaaaccgattcttcaatgtgcggaaccgagtcatgggggtggatgtccaggccctgaacaaccaggtgggagaccgaaagcgtcgggaagcagcagaaagaagcaaggaggcagcttatggtaccagccaggtgcagtatgatgtggtagtccagatgttagagaaggaagaggcagatcgaacacgtcagctggccaagaaagtccaggagtttcgggagcagaagcagcagctcaagaacgggcgtgaatttagtctttgggatccaggccaagtctggaaggggcttccaacctatcttagttacagtaatacctatcctggtccagccagcctgcagtacttctctggggaagacctagacagggacacacggctgagaatgcagcaggggcagttcaggtacaacttggaaaggcaacagcaggagcaacagcaagccaaggttgatgagaattatacagatgcgctcagtaaccagctgcgcctcgccatggatgcacaggccacccatctggccaggctggaggagtcctgtcgtgcggccatgatgtgtgccatggccaacgccaacaaagcgcaggcagctgtgcaggctgggcgtcagcgctgtgagcgtcagcgtgaacagaaggccaaccttgcggagatccagcaccagagcacgagtgacctactgactgaaaacccccaggtcgcccaacaccctatggctccctaccgggtcctgccctattgctggaagggcatgactccagagcagcaagctgccatcaggaaagagcaggaagtacaacgctctaagaagcaagcacaccgtcaggctgagaaaacactggatactgaatggaaaagccagaccatgagctcagcccaggcagtgctggagctagaagagcaggagagggaattgtgtgctgtatttcaaaggggtctaggatccttcaaccagcagctggctaatgagcaaaaagcccagcaggattacctgaattcagtaatctacaccaatcaacctacagcccagtatcaccagcagtttaacaccagcagccgctaagttcaggatgtctatctctctctcccttctcctccatcaagctcacaggtggttaggagtcaaagagaaaaatgctgcatactcccaccttctaacctaggtaataaagttctgcactcaaaatcaa

SEQ ID NO: 176132 - DNA, 1281 bp, Homo sapiens
  Payload ID: 14581
  Gene Symbol: RIBC1
  Gene Name: RIB43A domain with coiled-coils 1
  Uniprot ID: Q8N443
  ENST ID: ENST00000414955
  CDS Start-End: 239-955
acttgctcctgcggaccagatccccggaggagttgttgctgggcggagtcagagcagttcttgaggttcaaggaggcgggggagacctgagctcacgcttgctgagacagaagtcacagcaggattatgcccctcagggcaagaggaagagttcagaaactgccgccgtaacccaagaacaaagttgcatgcagagccaacctaagagcttcaaaatcgggattccttactgagaaagatgtataacataaaacagtcaacagataccaaggaagcagcagccatcgaggctagaagaaatcgagaaaaagagcgacaaaaccgattcttcaatgtgcggaaccgagtcatgggggtggatgtccaggccctgaacaaccaggtgggagaccgaaagcgtcgggaagcagcagaaagaagcaaggaggcagcttatgatgcgctcagtaaccagctgcgcctcgccatggatgcacaggccacccatctggccaggctggaggagtcctgtcgtgcggccatgatgtgtgccatggccaacgccaacaaagcgcaggcagctgtgcaggctgggcgtcagcgctgtgagcgtcagcgtgaacagaaggccaaccttgcggagatccagcaccagagcacgagtgacctactgactgaaaacccccaggtcgcccaacaccctatggctccctaccgggtcctgccctattgctggaagggcatgactccagagcagcaagctgccatcaggaaagagcaggaagtacaacgctctaagaagcaagcacaccgtcaggctgagaaaacactggatactgaatggaaaagccagaccatgagctcagcccaggcagtgctggagctagaagagcaggagagggaattgtgtgctgtatttcaaaggggtctaggatccttcaaccagcagctggctaatgagcaaaaagcccagtgagttctaggtggtagtggtggagataaatgccaagggagggagaggagggatggtgaggaaccatggagagagggaaagcatgtcagctgagacctctggacttctttcacaggcaggattacctgaattcagtaatctacaccaatcaacctacagcccagtatcaccagcagtttaacaccagcagccgctaagttcaggatgtctatctctctctcccttctcctccatcaagctcacaggtggttaggagtcaaagagaaaaatgctgcatactcccaccttctaacctaggtaataaagttctgcactcaaaatcaagtcca

SEQ ID NO: 176133 - DNA, 1949 bp, Homo sapiens
  Payload ID: 14581
  Gene Symbol: RIBC1
  Gene Name: RIB43A domain with coiled-coils 1
  Uniprot ID: Q8N443
  ENST ID: ENST00000457095
  CDS Start-End: 205-783
gttgctgggcggagtcagagcagttcttgaggttcaaggaggcgggggagacctgagctcacgcttgctgagacagaagtcacagcaggattatgcccctcagggcaagaggaagagttcagaaactgccgccgtaacccaagaacaaagttgcatgcagagccaacctaagagcttcaaaatcgggattccttactgagaaagatgtataacataaaacagtcaacagataccaaggaagcagcagccatcgaggctagaagaaatcgagaaaaagagcgacaaaaccgattcttcaatgtgcggaaccgagtcatgggggtggatgtccaggccctgaacaaccaggtgggagaccgaaagcgtcgggaagcagcagaaagaagcaaggaggcagcttatggtaccagccaggtgcagtatgatgtggtagtccagatgttagagaaggaagaggcagatcgaacacgtcagctggccaagaaagtccaggagtttcgggagcagaagcagcagctcaagaacgggcgtgaatttagtctttgggatccaggccaagtctggaaggggcttccaacctatcttagttacagtaatacctatcctggtccagccagcctgcagtacttctctggggaagacctagacagggacacacggctgagaatgcagcaggggcagttcaggtacaacttggaaaggcaacagcaggagcaacagcaagccaaggttgatgagaattatacaggtaagcagcccggccctccagactcagagacctgaggcctagtggggatctgtcctaagctgagtacagcagccaggggaccagaactgtgtggggaggtccacttatccatagggttggtgctgaaatgttaggttgtgcagaccccaacctccctgacttccttcagtaactgacagtgtagcattgttcttgattagtttggcactccattacgtggaggcagcacagtgcagacagacctaatggctctgccacttactagctggtttgggcaaatgaattttcccttctgtgcttcagtttcttcatctttaaaatgagaataataatttataccacatagagtagctactattatgatattgtctgtggccacatccttctcttccattagaagaagcccttcaagggcaaggaccatgtcttatctacttgcactgttcacccttcacatcaaccctgttacagcactctgttctgctggaccacttattgtagttgtagctaattgtgaaagtatttgtttaatatctgtcttctccctaaaatgtcagcctactgaagatgaaccatctctttcatgtctacccatctcccagttgcatagtacagtgtctgacaggtcttaggaacagcaaggagctcagtgtggctggagcagaaaaaaattgtcagtacctttgctcatgccatgccctcagcctggaatgccctttgctcttttagcctgtatacaaaatgtatttcaaggatcacctcttcctggaagccttcctcttttccaccatccaaaaccctcttaataccctgtgtacatccctgccattgctcttgccagattgtggtctatgtttgatctgtgtccccaactagacagggagttctctgaggacaggatttaattcgatggtatcattagaacccagcacatggcccttagactgagattcagagatatgaaatgatttacccaaaatcacacagctcagaagcagcagaactgacattgggacccaggtccattggaggcatcttttagttatgcgcttgagaaatcgttgttgctgcacctagttccttccacatccctacaactcggacactaaccccctcctaaacattcgtacacacacaaacacaaaacttgctgaacaaatggctggatgagtgaaacaggaatggagcaagccagtacagt

SEQ ID NO: 176134 - DNA, 1479 bp, Homo sapiens
  Payload ID: 14582
  Gene Symbol: RIBC2
  Gene Name: RIB43A domain with coiled-coils 2
  ENST ID: ENST00000614167
  CDS Start-End: 197-1345
gagttgttgacatttccgagagagcgggagcgtctgtacctctgcggcgtcactgggagcccgacggaaaactgcgctaaaggcttgtctttcccctgcccgaccgaaggagccgaccttgcctgcgctacagcttccttattttcgtcgcctgttctcctgatcctgcgtgttctaaaaaccccttaggctttccatgggttcccagaccatggcggtggcgctgcccagggacttgcggcaggacgccaacctggcaaagaggaggcacgcggagctgtgcaggcagaagcgggtcttcaacgccagaaacaggataattgggggagacactgaagcctgggatgttcaagttcatgaccagaagataaaagaagctactgaaaaagctagacatgaaacctttgctgctgaaatgaggcaaaatgacaaaatcatgtgcatattggaaaaccggaaaaagagggataggaaaaatctctgtagggctatcaatgacttccaacagagctttcagaagccagaaactcgccgtgaatttgatctgtccgaccccctagcccttaagaaagatcttccagcccggcagtcagataatgatgttcggaatacgatatcaggaatgcagaaattcatgggagaggatttaaacttccatgagaggaagaaattccaagaggaacaaaacagagaatggtctttgcagcagcaaagggaatggaagaacgcccgtgctgaacaaaaatgcgcagaggccctctacacagagacaaggctgcagtttgacgagacagccaagcacctccagaagctggaaagcaccaccagaaaggcagtttgtgcatctgtgaaagacttcaacaagagccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataatgaggaacacacccttgttcccgtcattcacgtataaagagtggctaccttaaagagtcacgtttcttttttaaagatacactccttgggccacaagtacccttcagctgtaatcgtccactgtggacaaaaca

SEQ ID NO: 176135 - DNA, 2684 bp, Homo sapiens
  Payload ID: 14583
  Gene Symbol: RFK
  Gene Name: riboflavin kinase
  Uniprot ID: Q969G6
  ENST ID: ENST00000376736
  CDS Start-End: 335-802
aagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccattccccgagcggactgcattatgaggcacctgccttacttctgccggggtcaagtggtgcggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtgatattttttctt

SEQ ID NO: 176136 - DNA, 2386 bp, Homo sapiens
  Payload ID: 14583
  Gene Symbol: RFK
  Gene Name: riboflavin kinase
  ENST ID: ENST00000490113
  CDS Start-End: 1-363
cggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagcaggctggctgcttctctccagcggtatgaagttaatgaaatctttcaaaatgtgtgaagtttgagatatagtaaatcagagaacatttgaaacatgttaccagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaa

SEQ ID NO: 176137 - DNA, 1973 bp, Homo sapiens
  Payload ID: 14584
  Gene Symbol: RBKS
  Gene Name: ribokinase
  Uniprot ID: Q9H477
  ENST ID: ENST00000302188
  CDS Start-End: 754-1722
caggcaacaaggaactaatactcggggtttacaggaaccaggggatgggccagatatggagaaagagacgcctctggccttgggggctcgttcttgagggaatcagcgtgatggggatgagaagggcatctttggaacgggggccttctccataggaagaggaggcgagtcccctggccatatttaaaccacagttctccacgccacctgtgcgactcgggatccaacctccccgcaccagccccagtccaggtacctggaacttagtccgatcggtaaccggcgactacgtggggtacaggtacccgagcgcgcccccgacagacgcaccgacctgcgcgcgcgccgcgggcaggatgcgtgcgcactccccggacgtcccgccccgccccctctgcggccccgaagctgggcggcgtgcgcgcccccgcgccgcgccgagccgggcgctcggaaaggcgtccccgcggtgcctgacagttccttcctcagcgcctgccccgtgagtgacgaggagcgcggagtctcgccatatcaggagggccctgttacgtgaggctgtgcaccgagactattccaggaagaagaggggacacttggtgggcggggtgatttcgggcagtcaggtgggcgacccgcgtaggcgtctgaaaggcccgcgtcgttagggagggcaggagtggcgtctctggttacggggtcgggcaaagggcagaggtcaccgtccaggttggacagcagcacctttgagcgatggcggcgtctggggaaccccagaggcagtggcaagaggaggtggcggcggtggtagtggtgggctcctgcatgaccgacctggtcagtcttacttctcgtttgccaaaaactggagaaaccatccatggacataagttttttattggctttggagggaaaggtgccaaccagtgtgtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaaggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaatgtcctcgtcccctttctttgcaaatattagttcttttacgaagtcatcctcaagcttcaatttatttataacgatgattcttttgctttccatgcatttgcacaaaacaaccagaattaaagattccacaaccaagatctgtacaaacataaagacaagtaacctcaa

SEQ ID NO: 176138 - DNA, 735 bp, Homo sapiens
  Payload ID: 14584
  Gene Symbol: RBKS
  Gene Name: ribokinase
  ENST ID: ENST00000458185
  CDS Start-End: 1-442
caatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgtgtagacctggctcaagacccaagagtgaagcagcaagtgtgaagaagcagaaacattataaataacccagagaatccttttataacagcaactgcctactgattttgtggcctaacagctcgagcaaaaatgaatataaatacaacattgtgcaatgactaattactcaaaattttgtgcatcagcagaagtggaacctgtggttggtgctaatattatgaaatgcctttgctgtttaataatctggtagctctgtattatttagcatgcatttttcttggagaacaatgattttatttcaagtacctctcactgaaataaaaaagcagctgttagaagatgaacatttagcagaaaa

SEQ ID NO: 176139 - DNA, 2151 bp, Homo sapiens
  Payload ID: 14584
  Gene Symbol: RBKS
  Gene Name: ribokinase
  ENST ID: ENST00000449378
  CDS Start-End: 22-213
ggacagcagcacctttgagcgatggcggcgtctggggaaccccagaggcagtggcaagaggaggtggcggcggtggtagtggtgggctcctgcatgaccgacctggtcaggaggatgtgcatgaggatatgttatgtgcacttttgttgccagcccacaccacagctgcagaactgttcaagtctttgcgtgattacatgtcaggaaaactgaactggtcattttgtgtgagtatatgcatggacagagtggctgccatggctggacagcttctggtttcactactcacatcaaagaggttgcttctgaatgtgagtctacacaccatgtcatccatagagaaatgctggctagccaaaaaatgtcacctgaacttaacagcattttgcaggatgtgattaaaattatcaaccacgttaaagtacatgcccttaactcacgtctcttcgcacagctctgtgaggaggtgggtgcagtgcacacatgtcttctctcacacacacaagtgagatggctttctaaaggtagatcactgatcagagtttttgagttacaagagccactccggagatttcttttagaaaaacagtcaccactggcagcacatttcagtgacacagaatgggttgcaaacctggcttccttgtgtgacatattcaacctgctcaacgaactcgatctgtcacttcaggggagaatgacaactgtgttcaaattgtcagataaaggggctgcattcaaagccaaactggaattatgggggtgacaagtgaacatggggatttctgacatgtttcaaacattagcagatattttgaaagagactgaaccagggccttctttcccccagctggtgcatgatcacctatctcagcttttaaaggagtttgagcattacttcccaaccacaaaagaccccccagactgggaaggaatggatctgcaacccatttgtggataagccaaggtgaatcgactttgtccgtgctggaaaaggaccaactgcttgagatcgcaaatgacggtggccttaaaagtatgttgaaacagcttcaaatcttcacacagtccggattgaagtcaaggcataatatccagagactgccccaaaagcactgaaaagcttgcttccatttccaacaccctatctttgtgaagcagagttttctgcagtaacagcaaccaaaacgagattatggagtagactggacataaacaacacacttcagtcttacttctcgtttgccaaaaactggagaaaccatccatggacataagttttttattggctttggagggaaaggtgccaaccagtgtgtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaaggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgt

SEQ ID NO: 176140 - DNA, 630 bp, Homo sapiens
  Payload ID: 14584
  Gene Symbol: RBKS
  Gene Name: ribokinase
  ENST ID: ENST00000453412
  CDS Start-End: 337-447
gtgcgcgcccccgcgccgcgccgagccgggcgctcggaaaggcgtccccgcggtgcctgacagttccttcctcagcgcctgccccgtgagtgacgaggagcgcggagtctcgccatatcaggagggccctgttacgtgaggctgtgcaccgagactattccaggaagaagaggggacacttggtgggcggggtgatttcgggcagtcaggtgggcgacccgcgtaggcgtctgaaaggcccgcgtcgttagggagggcaggagtggcgtctctggttacggggtcgggcaaagggcagaggtcaccgtccaggttggacagcagcacctttgagcgatggcggcgtctggggaaccccagaggcagtggcaagaggaggtggcggcggtggtagtggtgggctcctgcatgaccgacctggtcaggagatacatcaggacacagtgatgaacatttgttgaattagtgcatgaatgaaggaatatatgacttctagttacagttcttgcttgtggaagaggaatgctgctgatactgggagtgcagtgggcaagatctgtcttacttctcgtttgccaaaaactggagaaaccatccatggacataagttttttattggctttggaggga

SEQ ID NO: 176141 - DNA, 54 bp, Homo sapiens
  Payload ID: 14584
  Gene Symbol: RBKS
  Gene Name: ribokinase
  ENST ID: ENST00000612015
  CDS Start-End: 1-54
gtattatccttgtaccttttctgtaaatctaaaactaaaaaaaatgtcctcgtc

SEQ ID NO: 176142 - DNA, 1887 bp, Homo sapiens
  Payload ID: 14585
  Gene Symbol: RNASEH1
  Gene Name: ribonuclease H1
  Uniprot ID: O60930
  ENST ID: ENST00000315212
  CDS Start-End: 357-1217
ggggagagaaggggcccaacatggtccatctcgaccttcctctgccgggcccagggcttcagccccgctcccataggccccgccccatcccagacctcgcccgccttcgggatctcagccctggctccgcttcttcaagtaccgacaggaagttgacgagttcgggctcgtcaggggccgagctccgggctccgccctacgacaccgcccctccctaggccccggccctcatcaggactccgcccagacgtgcgtcatcttcccgcgccggtgacggaagtgcggtgttgagcgccggcggctcgcgcccacgctgggccgggagtcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggaatgagtgcagagcacaggtggaccggtttcctgctgccagatttaagaagtttgccacagaggatgaggcctgggcctttgtcaggaaatctgcaagcccggaagtttcagaagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggagacttcgtcgtcgtctacactgatggctgctgctccagtaatgggcgtagaaggccgcgagcaggaatcggcgtttactgggggccaggccatcctttaaatgtaggcattagacttcctgggcggcagacaaaccaaagagcggaaattcatgcagcctgcaaagccattgaacaagcaaagactcaaaacatcaataaactggttctgtatacagacagtatgtttacgataaatggtataactaactgggttcaaggttggaagaaaaatgggtggaagacaagtgcagggaaagaggtgatcaacaaagaggactttgtggcactggagaggcttacccaggggatggacattcagtggatgcatgttcctggtcattcgggatttataggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattggagaattatgtgagatttccacattatgtttactgggttcaatactgtccttgcttgttttattgcaggcaagcaaggcaaatggcctaaaatgctgtggcttatattttgataagaaatcaaaaaaccattggttaaaagatgcaactcagaagtctggaagtattctgaaagcatccatttaccgtccagttgacaggtttgagtctcctgcttgtataggtgacttgtgcccatgggtacattaaaggaacatgctgcccagggcctgggcggacagctcagtgggcaggatgtgtgctgggtctcagccccatgtgcctgcttgctgggcagttagtatagggcaaagcctgcctgcggcgaccctggctgctaggccattctctaggaacagctgcgactcataaagaccaagaagcataaataaactttcaaaaatttatttggctctttcgttaaaa

SEQ ID NO: 176143 - DNA, 2120 bp, Homo sapiens
  Payload ID: 14585
  Gene Symbol: RNASEH1
  Gene Name: ribonuclease H1
  ENST ID: ENST00000436842
  CDS Start-End: 30-161
gaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggtgagtggcccgcccgccgaggcgcctccctgccggcatcggggtcgagggaggccggagcccggctaaccccggcggcgggagcctggcggtccgagtctgtgccgcgcgctgtggctgtgggtggtcgggggaccgcctcgttttcctgctcggccggcggggttccaggaggctcatggcctgggactggaacgcaccgaagacttgtttgaaatatcagaaacgtcgcgtaaaggaatgagtgcagagcacaggtggaccggtttcctgctgccagatttaagaagtttgccacagaggatgaggcctgggcctttgtcaggaaatctgcaagcccggaagtttcagaagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggagacttcgtcgtcgtctacactgatggctgctgctccagtaatgggcgtagaaggccgcgagcaggaatcggcgtttactgggggccaggccatcctttaaatgtaggcattagacttcctgggcggcagacaaaccaaagagcggaaattcatgcagcctgcaaagccattgaacaagcaaagactcaaaacatcaataaactggttctgtatacagacagtatgtttacgataaatggtataactaactgggttcaaggttggaagaaaaatgggtggaagacaagtgcagggaaagaggtgatcaacaaagaggactttgtggcactggagaggcttacccaggggatggacattcagtggatgcatgttcctggtcattcgggatttataggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattggagaattatgtgagatttccacattatgtttactgggttcaatactgtccttgcttgttttattgcaggcaagcaaggcaaatggcctaaaatgctgtggcttatattttgataagaaatcaaaaaaccattggttaaaagatgcaactcagaagtctggaagtattctgaaagcatccatttaccgtccagttgacaggtttgagtctcctgcttgtataggtgacttgtgcccatgggtacattaaaggaacatgctgcccagggcctgggcggacagctcagtgggcaggatgtgtgctgggtctcagccccatgtgcctgcttgctgggcagttagtatagggcaaagcctgcctgcggcgaccctggctgctaggccattctctaggaacagctgcgactcataaagaccaagaagcataaataaactttcaaaaatttatttggctctttcgttaaaaactgtgcaaattaaaaaaaaaaaaaaaaaagtaagacaccggctgggcacagtggctcacttctgtaatcctagcactttgggaggccaaggcgggcagatcacttgaggtcaggagtttgagaccagcttggccaacatgacgaaaccctgtctctactaaaattacaaaaattatccaggtgtggtggcacgggcttgtagtcccagctacttgggaggctgaggcacaagaatcacttgaacccaggcggcagaggttgcagtgagccaagattgcaccactgcactccatcctgggcaacagagtgagactctgtctc

SEQ ID NO: 176144 - DNA, 749 bp, Homo sapiens
  Payload ID: 14585
  Gene Symbol: RNASEH1
  Gene Name: ribonuclease H1
  ENST ID: ENST00000454734
  CDS Start-End: 73-204
gtgttgagcgccggcggctcgcgcccacgctgggccgggagtcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctgttaaagtgcaacaaaaagtgacacgtaatcagaacgaacccccgttaccagaagactttccgtaccagctaaattgggattggaactcagtacctaatcttcccttttaaaaaaggcaaattctaataagccagtatttgcagttggatccttgtaacaacccttggaggaatgagtgcagagcacaggtggaccggtttcctgctgccagatttaagaagtttgccacagaggatgaggcctgggcctttgtcaggaaatctgcaagcccggaagtttcagaagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggagacttcgtcgtcgtctacactgatggctgctgctccagtaatgggcgtagaaggccgcgagcaggaatcggcgtttactgggggccaggccatcctt

SEQ ID NO: 176145 - DNA, 1165 bp, Homo sapiens
  Payload ID: 14586
  Gene Symbol: RNASEH2A
  Gene Name: ribonuclease H2, subunit A
  Uniprot ID: O75792
  ENST ID: ENST00000221486
  CDS Start-End: 95-994
aagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgctctgcagccgggtccagctacttccttttggaaccttaaatagaatgggtgttggttgat

SEQ ID NO: 176146 - DNA, 1629 bp, Homo sapiens
  Payload ID: 14587
  Gene Symbol: RNASEH2B
  Gene Name: ribonuclease H2, subunit B
  Uniprot ID: Q5TBB1
  ENST ID: ENST00000336617
  CDS Start-End: 400-1338
ccgctggctagaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgtta

SEQ ID NO: 176147 - DNA, 4830 bp, Homo sapiens
  Payload ID: 14587
  Gene Symbol: RNASEH2B
  Gene Name: ribonuclease H2, subunit B
  Uniprot ID: Q5TBB1
  ENST ID: ENST00000422660
  CDS Start-End: 276-1049
cgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagatggcagcacaaagacagaaaaggggcaagtgatggtggtggctccacgcaaggcttggcggttttccctgcaacttcagacactcccagaggactcggactttttcttctgcacttttttggaaaatcgccaggtgccaaaaggtgcattttaaagcgctgactgtaaatgctttatttctttgattagtaccactagtctatgtgggcagcggcattcctccctggagcactcagctaggcggttccgtccaggagcttgaaagcatcccagcggtgcacctgttcagtctgaggacctcaagcttgggtcaggccagcatgttttaggtatggatgtggtgacttaaagtacttgattgtcttgatttcaccctgaaagctttggcaaaccaagtttcaacccttactttaaaaatctgacactgctttactccatatcaatttggaagcttctaattcataaatatacctaaacgttggcattttatctctccaggagttattaaacatttcttcctttttagaagatttgtccagtatgtgtattattttatttttcagagtaaggacataggagatgacggaaggttggaagtagatgccaaaaagtgatttggtggggaatctggtgcgtagtgcatatgttttagcaggtagtgggaggttttgtgcaaaaatgtctgtggatttgagctggcttgtccacttgacatgcaagaggaatgtgtgggtgctgctcagctgatcttcccgcattcacacaggaccccaatctgcttcttcaggaaataattttgtttctgaatctctgactacaaggagtattaataattagatcctagttctgggaagtagtctgccacttttccacacctcccttcacatgtagaaatttttgttaacctcaaaggactttaaaaattcctgcccttctgtagtggaaaagtgaatcttccctctgcaaaaaccaaagccactagatattgataatgtccaagtttgtcactagaaaccctgctgtcttacctgtgccccaagtttctgttccaacactttaaattcaaacacctaacattacaagatttcattgggttgttttttttcttttcacaagtaattcatgatacattctcacaaaaagagaaggcagaagtgatccccacctcccactgccagcactactcaggctcccctgggtgactgcatccttgaccctgaatcaagcatgtttcttagttatccagtttcccacttccagtttctatcttttgccttgcagcccgagcagccctacagtcactgttcatgcaatccatttcatcgtttcatctaagaatccaatcctattgagctctccttcagaaatacctcatgggaaaattaaaattaagacaaatcaagaaatagaaaactccagcacttgaataagcccttttctctcttttttttttttttttttggagacagagtcttgctctgttgcccagattggagtacggtggtgcaatcttggctcactgcagcctctgcctccaggttcaagcgattcttctgcctcagcctcccaagtagctgggattacaggcacgcaccaccacgcctggctaatttttttaaaaattatttttagtagagacggggtttcaccatgttagccaggctggtctcgaactcctgaccgcaagtgatctacccacttcagtctcccaaagtgctgggattacaggcgtgagccaccgtgcccggctagccctttcttcttcatgcccactgccaccaagcataaggctgttctcttgagggcagagaccatatgggccatgtatcaaatagagacaaacccgcggtgctaagaacaccaagatagcactgagcatgccgcatgtatcccccactcagcgcatgagtcactgacacacaaggtgacatactccttccctatcaagttgtcaaggacttttagaaaacagccatgctcagagctagagaggaggtgggaagtgggccttgctggtaagaatagaaaatggtacaacttttggagaccaacttggaaataaatatgaaaagcctgaatttgttgcattttctttgtttcagcaatatccattgttagaaatacagccttaggaaataatcatgaatatgtgcaaagatttagctacaagaatattcactgtggttctgtttaaatagtaagtaattggaaaaaaactaaattagaaggctgaaattattttttaaacttttttactgggctgtgtgtggtggctcttgcctgtaattccagcactttgggaggccaaggtgagaggatcacatgtgcctaggagtttgagaccagcctgggcaacatagtgagacccccatctctagaaaaaataaaaattaaaagaaaaattagctggtcatggtggcatgtgcttatagtctcaggtacttgggaggttgaggtggaagaatggtttgagtctgggaggtcgaggctgcgatgagctattgatcacaccactgcactccagcctaggtaacagagcgagactctgcctcaaaaaaaaaaaaaaaaaaaaaaaaaaaaacaacaacaaaaaacaaatttgtactgcaagtataagtaatatctctttttctctctctttccccacttccttctttccttcttttctctcctttttttcctttctccttgtctcccttttttagaaatttttctagataaacatgttactattatgctaatacaaaaataaaactactcagttggttattttataccattagtccctcataattttcctctccagattataatctcttttaaaatttttgtgtctcatttagtaagtttcttggaggaagaaccatactatatatgtttcgcagttttttgcttagcattcaagtagatcttagcaaatcctaccagtatcaaataattgcccttcttctatccccacacctttagagtttcaggtctctactatccgattccttgacttcccaacccagtcaaagatacatgatttgcttggaattgtgtgtttggggcatgtacacacatgctgaaattaattaattttgctttgaagatttcctaagagccctagaaataattgcaaatgctctgcagtatatcacaaccaggactgataattactgtttctgtctacaaaactaaggggagagagaaaaacatactactgaatgagcagaacacagaagccagtgaatgtttcacacttggtgacgtgcagtttttgctgtttttttgccctagcagattgtaaccaaattgctcaacttcacagaaataactgtagagactcaatttctgaatgctcgtaattggcttttcaaaagaactttatagggataaattaattgctactatacttttaatggttttaaagttacttaggccacttctagaaatatgtaaaattgtatgatcctaacttaatgtttcatttctccctcagtttttatgtgatttgataatataatgaagggaactataaaaatttgatattgttggggcctttttagaaaattgagatacatttttctttgtatcattgttgctaaaagaggttaaatattgctacttattacctaggagaaagaacagcattttgtggcaaaataagtaggttataccgaatttgacagacttctctcctgaccgattttggagcacatatcttcatgtgccttgtaaaactagagatgcattcagttttcaatgttcccagatatattttaccactctatttttcccatatagcatctcaataaactgctgtttcataaa

SEQ ID NO: 176148 - DNA, 1495 bp, Homo sapiens
  Payload ID: 14587
  Gene Symbol: RNASEH2B
  Gene Name: ribonuclease H2, subunit B
  ENST ID: ENST00000611510
  CDS Start-End: 271-1269
gggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggtaaaaaataaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgtt

SEQ ID NO: 176149 - DNA, 346 bp, Homo sapiens
  Payload ID: 14587
  Gene Symbol: RNASEH2B
  Gene Name: ribonuclease H2, subunit B
  ENST ID: ENST00000616907
  CDS Start-End: 1-253
ggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaaggtatgtgggttcaggtgtagtggtgtttcgttcatactcagtgcgtgatgtgcatgaatacatgaggaacagttgcacgcttgattgtgattacagttttgaccaggaagaattattaacttgcatttctgtgacttaata

SEQ ID NO: 176150 - DNA, 2794 bp, Homo sapiens
  Payload ID: 14588
  Gene Symbol: RNASEH2C
  Gene Name: ribonuclease H2, subunit C
  Uniprot ID: Q8TDP1
  ENST ID: ENST00000308418
  CDS Start-End: 190-684
aaaacacaactggaaaaccctaggacttgaacccagggaaagcgttagggggtaaggggactacacttcccgtgaagctccgcggcggcttcccgtgaggccccgcggaggcttcctgagaggtcctgcgcgctttccgcgccagcttcagtgtcagctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcacctgtgagtctgggcgccttagagcccctaagccagcatgggccctttccccctccccaccaagaactttgcatggctctggcatatagaaacaatttattgccgggggcaataggggtaagagaagccagaaatttttgcagccagcacccaccccacccccaacttctactttacaaaagaaatttttacaatcaccagccctctgtacagagctcccccatccggatcccttctcactgtacacagctgcctggctccctctggtccctgcttcagaggaggcctgggcctgtggccagctgaccttggagttggtctgagcccggagctcgccttggtgctgggcaccagtgggcccctgccaggcctgtcctctcctttttgagctgtcctcagccccatctcccttagagtgctttgtgggagctgcagtgggggcggggtgggctatcagccccagtcctgctgccgtcttggcactgcagtgggcagtgtctggtcaccacttccccctcttgctccagtccttgggagtgaagtgcagacacttggagtcgatccgcaggagccgcttgagcatggcccgctcatggccatccacgatgtcctctgacagtgtgaggatgtactggccctgggcagaggagatgggttcagcaggtggtcagcccacagaggactgcactctgcatcccacacacctgtctcccctgcctgcctccctaccttgtagtagttgatgagattgaggtactgcagagtggagatgacatcctccttcttgatgctggtgatttcactaatctcactgtgggagagcacaggtcaggttccctgaggacctttatctgtccccaggagccctgagagagaaagcccaggaacagacaagccatgccatgtacccccaggtagacagcgccaggctcacttgatggtgatctgtggcctctccccgctctccgacttcagccccatcaggatctccaggatggtctgggaccagtagcttcgataggataggaggccaaggtctgagaggggcttctcaggggtccctgttttcccttccactttggagagttcatagcctaaagcaatggagcaggagagggtgagtaagaggtcacagatgaacataagcaacatttaaaaacacaggttgccaaggcaggctgcctagttcctatcatggccctgccacttggcagttctatgccctccacttctctgtgcctcagttccctcaggaagaactgagtattcactctttccgtgcgctgagcacagtggagggcatgagggcactgagaggagcagctgcagtcaaccatgagggtgatcagaggccagtgaaggcttatgggcaggggatgcagagaaaatggctcatgggaagaaggggcctccaattttcctttgccatcccgggctctgtgtctagccatgtaaggaagtggagacagattcctgtctctaatccagacctgagaatgcttgaattctcaaagtcctcctagctgggaccttgggagtgtcacctgctgtaagacttgagtggcctgactgggtggttgtgaggatgcaaggagaaaaggtgcaccaaggtgcttcctaagtcggggagaccattcctgggagccacgtgactgacccccaccatggctctttccctccaactcgtgctgatagctggccgctgggaggccgtccccagtgagatcctcagaccctgcacagccctgagtggcttcacatctcttggtcagtgtcttcattctccccagtcagggacctgggatgtttgttacttctagaagcccttcctcaccctcataatggaccttagccccttgctggtcccactcacatcccgtctccattgctgtctgagttccaagactgagtttcttcaagcatccacttgtgctaccaggctgagaagttctgaggatgtgaccccatctgggcatcatttaaccaataaaatttctcgaatggaccataa

SEQ ID NO: 176151 - DNA, 1337 bp, Homo sapiens
  Payload ID: 14588
  Gene Symbol: RNASEH2C
  Gene Name: ribonuclease H2, subunit C
  ENST ID: ENST00000528220
  CDS Start-End: 479-724
gcgctttccgcgccagcttcagtgtcagctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggtgagccctgcggccggactacggctcccggcagcccccgcgccggcctgcgcgcttctcatcgcctgggctcctggggatcgtggtccgtccggaggtggcgggagggcagctccgggctcgacccagcgtgggtcctgcctgaggccctttgcgcctcccgctccaggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcacctgtgagtctgggcgccttagagcccctaagccagcatgggccctttccccctccccaccaagaactttgcatggctctggcatatagaaacaatttattgccgggggcaataggggtaagagaagccagaaatttttgcagccagcacccaccccacccccaacttctactttacaaaagaaatttttacaatcaccagccctctgtacagagctcccccatccggatcccttctcactgtacacagctgcctggctccctctggtccctgcttcagaggaggcctgggcctgtggccagctgaccttggagttggtctgagcccggagctcgccttggtgctgggcaccagtgggcccctgccaggcctgtcctctcctttttgagctgtcctcagccccatctcccttagagtgctttgtgggagctgcagtgggggcggggtgggctatcagccccagtcctgctgccgtcttggcactgcagtgggcagtgtctggtcaccacttccc

SEQ ID NO: 176152 - DNA, 913 bp, Homo sapiens
  Payload ID: 14588
  Gene Symbol: RNASEH2C
  Gene Name: ribonuclease H2, subunit C
  ENST ID: ENST00000534482
  CDS Start-End: 1-389
ggagggcagctccgggctcgacccagcgtgggtcctgcctgaggccctttgcgcctcccgctccaggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcacctaatgatctctgcctttcacaaagaccacctttgtgcatccatgcctactcttcagaacaccactgcaagaaatcccctcagccactttgtcatccaccaaggctgaaaggtaaccctctatgaagctctgctgaccacctcctttgggtcctgctaacctaccctctgtttcatgacacttaggacactgggagctagaggtcattggtatgactgtctctcccatggactaagctgtcagagaacagagactgtctcattcctggctaccagcacctgccagacagcaggaactcaataaaaatgggctggactgatctgctggcttgactggtcagtgtttacctgagcaagaagaagctgtcatttgattcaccccagcgcctcactgcctctcaagcactaaccttgttcttacgtcc

SEQ ID NO: 176153 - DNA, 835 bp, Homo sapiens
  Payload ID: 14588
  Gene Symbol: RNASEH2C
  Gene Name: ribonuclease H2, subunit C
  ENST ID: ENST00000527610
  CDS Start-End: 44-787
ttcagtgtcagctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcggtgagtagacgaggagttccgtcttgcccccgggtggatgggctggggagcacaattgcgcagacggagcctggaggattctactgggtagtgtgtgggaagcgtagctccctgaccactcttcctagcatgtctagaagcggttattctgaacagctgggtccttcctcgggtatgggggccagcttgccgccctgtcttacaagtccaacagtagaggcgactcctgttgcagattcacgcacaggtgcccgaggactgagaaccagagcttgaaattcaaagctgcgatcccttcacagcagtaaaccagctctttggaac

SEQ ID NO: 176154 - DNA, 710 bp, Homo sapiens
  Payload ID: 14588
  Gene Symbol: RNASEH2C
  Gene Name: ribonuclease H2, subunit C
  ENST ID: ENST00000533698
  CDS Start-End: 1-374
gctcgacccagcgtgggtcctgcctgaggccctttgcgcctcccgctccaggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcacctgtagacagcgccaggctcacttgatggtgatctgtggcctctccccgctctccgacttcagccccatcaggatctccaggatggtctgggaccagtagcttcgataggataggaggccaaggtctgagaggggcttctcaggggtccctgttttcccttccactttggagagttcatagcctaaagcaatggagcaggagagggtgagtaagaggtcacagatgaacataagca

SEQ ID NO: 176155 - DNA, 968 bp, Homo sapiens
  Payload ID: 14588
  Gene Symbol: RNASEH2C
  Gene Name: ribonuclease H2, subunit C
  ENST ID: ENST00000531596
  CDS Start-End: 1-476
cggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcaccttccttgggagtgaagtgcagacacttggagtcgatccgcaggagccgcttgagcatggcccgctcatggccatccacgatgtcctctgacagtgtgaggatgtactggccctgggcagaggagatgggttcagcaggtggtcagcccacagaggactgcactctgcatcccacacacctgtctcccctgcctgcctccctaccttgtagtagttgatgagattgaggtactgcagagtggagatgacatcctccttcttgatgctggtgatttcactaatctcactgtgggagagcacaggtcaggttccctgaggacctttatctgtccccaggagccctgagagagaaagcccaggaacagacaagccatgccatgtacccccaggta

SEQ ID NO: 176156 - DNA, 4238 bp, Homo sapiens
  Payload ID: 14589
  Gene Symbol: RNASEL
  Gene Name: ribonuclease L (2',5'-oligoisoadenylate synthetase-dependent)
  Uniprot ID: Q05823
  ENST ID: ENST00000367559
  CDS Start-End: 255-2480
gacgcagcaggaggaaactgctcgggctgcaagcagtcttccaggctttgcggctgccaaaggaataattgagacgtctgagttgagcaggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcacttgctgattaaagctgttcaaaacgaagatgttgacctggtccagcaattgctggaaggtggagccaatgttaatttccaggaagaggaagggggctggacacctctgcataacgcagtacaaatgagcagggaggacattgtggaacttctgcttcgtcatggtgctgaccctgttctgaggaagaagaatggggccacgccttttatcctcgcagcgattgcggggagcgtgaagctgctgaaacttttcctttctaaaggagcagatgtcaatgagtgtgatttttatggcttcacagccttcatggaagccgctgtgtatggtaaggtcaaagccctaaaattcctttataagagaggagcaaatgtgaatttgaggcgaaagacaaaggaggatcaagagcggctgaggaaaggaggggccacagctctcatggacgctgctgaaaaaggacacgtagaggtcttgaagattctccttgatgagatgggggcagatgtaaacgcctgtgacaatatgggcagaaatgccttgatccatgctctcctgagctctgacgatagtgatgtggaggctattacgcatctgctgctggaccatggggctgatgtcaatgtgaggggagaaagagggaagactcccctgatcctggcagtggagaagaagcacttgggtttggtgcagaggcttctggagcaagagcacatagagattaatgacacagacagtgatggcaaaacagcactgctgcttgctgttgaactcaaactgaagaaaatcgccgagttgctgtgcaaacgtggagccagtacagattgtggggatcttgttatgacagcgaggcggaattatgaccattcccttgtgaaggttcttctctctcatggagccaaagaagattttcaccctcctgctgaagactggaagcctcagagctcacactggggggcagccctgaaggatctccacagaatataccgccctatgattggcaaactcaagttctttattgatgaaaaatacaaaattgctgatacttcagaaggaggcatctacctggggttctatgagaagcaagaagtagctgtgaagacgttctgtgagggcagcccacgtgcacagcgggaagtctcttgtctgcaaagcagccgagagaacagtcacttggtgacattctatgggagtgagagccacaggggccacttgtttgtgtgtgtcaccctctgtgagcagactctggaagcgtgtttggatgtgcacagaggggaagatgtggaaaatgaggaagatgaatttgcccgaaatgtcctgtcatctatatttaaggctgttcaagaactacacttgtcctgtggatacacccaccaggatctgcaaccacaaaacatcttaatagattctaagaaagctgctcacctggcagattttgataagagcatcaagtgggctggagatccacaggaagtcaagagagatctagaggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagagccgctataggacgcttcggaatgtgggaaatgaatccgacatcaaaacacgaaaatctgaaagtgagatcctcagactactgcaacctgggccttctgaacattccaaaagttttgacaagtggacgactaagattaatgaatgtgttatgaaaaaaatgaataagttttatgaaaaaagaggcaatttctaccagaacactgtgggtgatctgctaaagttcatccggaatttgggagaacacattgatgaagaaaagcataaaaagatgaaattaaaaattggagacccttccctgtattttcagaagacatttccagatctggtgatctatgtctacacaaaactacagaacacagaatatagaaagcatttcccccaaacccacagtccaaacaagcctcagtgtgatggagctggtggggccagtgggttggccagccctgggtgctgatggactgatttgctggagttcagggaactacttattagctgtagagtccttggcaaatcacaacattctgggccttttaactcaccaggttgcttgtgagggatgagttgcatagctgatatgtcagtccctggcatcgtgtattccatatgtctataacaaaagcaatatatacccagactacactagtccataagctttacccactaactgggaggacattctgctaagattccttttgtcaattgcaccaaaagaatgagtgccttgacccctaatgctgcatatgttacaattctctcacttaattttcccaatgatcttgcaaaacagggattatcatccccatttaagaactgaggaacctgagactcagagagtgtgagctactggcccaagattattcaatttatacctagcactttataaatttatgtggtgttattggtacctctcatttgggcaccttaaaacttaactatccttccagggctcttccagatgaggcccaaaacatatataggggttccaggaatctcattcattcattcagtatttattgagcatctagtataagtctgggcactggatgcatgaattccactccttccagaaccaactgcattggttttccatgaccttaaggcagtagttctcaactggggggcaattttgcactgaagagagcatttggcagagtctgaagaagtttttggtgtcacagctttgtggggagcatgctatggcatttagtgggtaaagaccagggatgctgccaaacctgccttgcacaggacagcccctgcaacaaagaattatccagacaaaaatatcaatggtgctgaggttgagaaaacctgacttaaggggctgggatgcttttgaactagcttaaggcccaggactgtggagtgtgtggaccaccccacagaggagggactcagatttatttactcttgctggatctgtagtgatggagttccttctggtgtcagccccacaggaggctcccaggcctccctcacttcccatacccagtctaggagctccttctggctcccaagcacccagagctttcctccgccttttagttttggttcctccactggaatgtaggctcctcacgggcgatggctgtcttttcttgactttgtatcttcactgccaagcaaaaagtctgccaagtgggaatgtttaataaatattcattgaataatgaatgaaccatcttcgtacatgaataataatactgtcttacgtttttctggtgctttataatgtatacattacatctgagtattttattttatttaattttcaaaacaatcctttaaggtcaacattgttatccctattttgctgatgaggaaactaaggttagaaacattttgatttcctctaggacgtatagctaggaagtgttactatcttgatttgaacaaattttctggtgctaagtctgatgttctttccatgaatcattgtggtggttgagatggagctttgtaatgggaataaaacagtaccttaggttctttctgaaaaggaggtatctagcaatggataaatagataccactgaatgaaattaaatgttgattaggaacaaatttaaggcttaaaaaatactttatgagcagcaagattgctttaacttttaaaatgaagctttggttctctgatttgtaatgagcacctggacatgtcaattaaaatgcccatttgtgaagcttactcaataaaactttaaattgtctta

SEQ ID NO: 176157 - DNA, 4046 bp, Homo sapiens
  Payload ID: 14589
  Gene Symbol: RNASEL
  Gene Name: ribonuclease L (2',5'-oligoisoadenylate synthetase-dependent)
  Uniprot ID: Q05823
  ENST ID: ENST00000539397
  CDS Start-End: 255-2213
gacgcagcaggaggaaactgctcgggctgcaagcagtcttccaggctttgcggctgccaaaggaataattgagacgtctgagttgagcaggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcacttgctgattaaagctgttcaaaacgaagatgttgacctggtccagcaattgctggaaggtggagccaatgttaatttccaggaagaggaagggggctggacacctctgcataacgcagtacaaatgagcagggaggacattgtggaacttctgcttcgtcatggtgctgaccctgttctgaggaagaagaatggggccacgccttttatcctcgcagcgattgcggggagcgtgaagctgctgaaacttttcctttctaaaggagcagatgtcaatgagtgtgatttttatggcttcacagccttcatggaagccgctgtgtatggtaaggtcaaagccctaaaattcctttataagagaggagcaaatgtgaatttgaggcgaaagacaaaggaggatcaagagcggctgaggaaaggaggggccacagctctcatggacgctgctgaaaaaggacacgtagaggtcttgaagattctccttgatgagatgggggcagatgtaaacgcctgtgacaatatgggcagaaatgccttgatccatgctctcctgagctctgacgatagtgatgtggaggctattacgcatctgctgctggaccatggggctgatgtcaatgtgaggggagaaagagggaagactcccctgatcctggcagtggagaagaagcacttgggtttggtgcagaggcttctggagcaagagcacatagagattaatgacacagacagtgatggcaaaacagcactgctgcttgctgttgaactcaaactgaagaaaatcgccgagttgctgtgcaaacgtggagccagtacagattgtggggatcttgttatgacagcgaggcggaattatgaccattcccttgtgaaggttcttctctctcatggagccaaagaagattttcaccctcctgctgaagactggaagcctcagagctcacactggggggcagccctgaaggatctccacagaatataccgccctatgattggcaaactcaagttctttattgatgaaaaatacaaaattgctgatacttcagaaggaggcatctacctggggttctatgagaagcaagaagtagctgtgaagacgttctgtgagggcagcccacgtgcacagcgggaagtctcttgtctgcaaagcagccgagagaacagtcacttggtgacattctatgggagtgagagccacaggggccacttgtttgtgtgtgtcaccctctgtgagcagactctggaagcgtgtttggatgtgcacagaggggaagatgtggaaaatgaggaagatgaatttgcccgaaatgtcctgtcatctatatttaaggctgttcaagaactacacttgtcctgtggatacacccaccaggatctgcaaccacaaaacatcttaatagattctaagaaagctgctcacctggcagattttgataagagcatcaagtgggctggagatccacaggaagtcaagagagatctagaggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagagccgctataggacgcttcggaatgtgggaaatgaatccgacatcaaaacacgaaaatctgaaagtgagatcctcagactactgcaacctgggccttctgaacattccaaaagttttgacaagtggacgactaagatgagcaagctgaggcacagacaaataatttttccaactacacagaaccagtaaggggtgcaccaggatttgaagctgggaaggatggctgcagaggccatgtgcttaagccacaccactacatgaagctgtgatggcatcaagtctaccaactcatttactcactgaggaaattgaggctcagagaccacactcaaattactcatgctggacagtcagagattggcagacctggaaagaggaacttgttcttttatttcccaatttattggttcttttccctaaattccatgggcttatattgaattttgatagtcttcaggttttaacttcaagttttaccttttaattcccattttacactttgtttttctgttgacttgcccattttcatggtcacacaattaattttgtcagcataggtctggagcccaagttttccagcttgtatgactgtattggttcttgacttgccccatcctgccacacatacgtgcttggcgtttctcacgggtgttctgcacagagtgcacctggccagtctcagcagcatcctcactagcattgctctttcatcagttactcttcctaagtgacccactggattcttgactgttgcatcttgatctcgtagcccaaactctttctaaatatgagagccatctatggctctgtatctatgagggtgacaagcacagacaaagaggatgacattactgtgatatgaaaggagttgccctgggacacctgcaggcaaggagaagcaagtaaccttgtttaaaatataaattttagagggtactagtatagttttgttacatggatatattgtgtagtggtaaagttgggcttttagtgtaaccattacctgaataacgcacattgtacccattaagtaatttctcatccctctccctccaaccctcccacctttccaagtctccaattatattattccactctgtacatccatgtgtacacattattgagctcccacttataagagagaacatgtgatatttgactttctgtttgtaagtcatttcacttaaaataatggcctccagttccgtccatgtggccacaaaagacatgatttcattcttcttttttatggctgaaatggcccagacacattttctttatccaatcatctgttgatggacacttaggtggattccatatctttgctattgtgaatagtgctgtagtaaacatatgagtgccggtatctttttgatataagatttcttgggctgagtgcagtggctcacacctgtaatcccagcactttgggaggccgagatgggtggatcatttgaggtcaggagtttaagaccagcctggccaacatggcaaaaccctgtctctactaaaaatacaaaacttagccaagcattgtggcacacgtctgtaatcccagctacttgggcggctgaggcatgagaattgcttcagcctgtgaagcagaggttacagctttattttggcagatactcagtacattcttttctctgcatcctcatcaacatctgttactttttgactttttaatagtagcccctagtataagatgatatctcattggttttaatttgcatttctctgatgattagtgatgttaagcattttttcatatgctttttggcaatttgtacgtcttcttttgagaaatgtctattcttgtcatttgcccactttttaatggtgttattattttttattgttaagttgtttgagttccttgtaaattctggatatcaatcctctgttggatgcatagtttgcaaatattttttttcccatgctgcaggttgtttgttcactctgtttatttcttttgctgcgcagaagtttttagtttaattaaaccccatctgtttcttt

SEQ ID NO: 176158 - DNA, 3121 bp, Homo sapiens
  Payload ID: 14590
  Gene Symbol: RPP14
  Gene Name: ribonuclease P/MRP 14kDa subunit
  Uniprot ID: O95059
  ENST ID: ENST00000295959
  CDS Start-End: 165-539
cgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatc

SEQ ID NO: 176159 - DNA, 7985 bp, Homo sapiens
  Payload ID: 14590
  Gene Symbol: RPP14
  Gene Name: ribonuclease P/MRP 14kDa subunit
  Uniprot ID: O95059
  ENST ID: ENST00000445193
  CDS Start-End: 412-786
acgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtaggtggaagccttccaaagagcggcggttgtctgggagccgtctcagttggccgcgacccgggcgcatgcgcggggcgggcggtgcgccttgggtagcttgtcctctccgaccccgggcgctgagggcctctgtacggcgccgcgtagggtctcggccgcagaacgtggccgagaggcccgggcgagacttcgggaccgtgtcctgagcgctctccatgcgcccggcgcgaggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggttttaaatatatatatatatatatattttctttttttcttttttgagatggagtcttgctctgtcgcccaggctggagtgcagtggtgcgatcccagctcactgcaagctcctcctcctgggttcaggccattctcctgcctcagcctcccaagtagctgggactacaggcgcctgcaaccacgcccggctaattttttgtatttttaatagagacggggtttcaccgtgttaaccgggatggtctcgatctcctgacctcgtgatctgcctgcctcggcctcccaaagtgctgggattacaggcgttagccattgcgcctggccgacaggttttaaattctaggagtggaattgctggatcatgtaactttaatattataaagaattgtcaaattgttgttcaaattactattgggcatgaggtggtatctcattgtagttatgatttccatttctctaatgtcagccaacacattcaagacaatctatgacagaatttttaatttttacccagagagcagctgaacagacaactagaaagaattattctaggccaggcgtggtggctcatgcctgtaattctcagcactttgggaggccaaggcaggcggatcacgaggtcgaggtcaagagattgagaccatcctggccatcatgatgaaaccccatctctactaagaatacaaaaaaattaactgggtgtggtggtgcgtgcctgtaatcccagctactcggaggctgaggcaggaagattgcttgaactgggaggtggaggttgcattgagctgagatcgtgcccctgcactctagcctgggcaacagagcgagactccgtctcaaaaaaaaaaaaaattattctagtcgctagagggcagtgttgtgtataaagttagtactttaaaactttaatactgtattataccatatactagttttctaaggtggaagacaagaccaaaatcaatgtggggagcaaggatactgttcttgtgagtttcagaatgtgcagcatgtgcaggctgagatccacttgaagaagacatttataggtgaatcactagacatgctgaaaatgtgttcaaatggcaaaacaaaatggggaacatgcacaaatatacggacttgaggccaggactgcttgctcctgcagaactcattccctgggatttagcagcagtcttaaagttaggtccataactggattgggatgtgatcattgatactgatagccaccattttttcaatgcctgatgagttgattttctacattaatgctaatccttgaaacaactgtgtgaagttaacattatcctgtttttaagtaggataactgacttgcccaaggttgttcagcgaataagcagtacagctgggattcaaacttgggcctgcctggctccaaagcctttcctttttccatcactctgtgggtcttaggttcctgtaggaaccaaggggaaacttcccctttgccctctgaaggttcactgaaaaatcaactgagaaaaggcaaattaattggagaaaaggcataccaatatattagcttgcatgaaggggagagctacagagtgattaccccccaaacccccacccaatagggtttagaagcttaaataccacctaaaggttacaaaaagagtgtgggctcggatcagtggcataacatgttcggggagctggagaaggggaagcctggctagcaaaggtggtcttgttatgtaaatgaagccccacaggtggcagccctcaaaagaatagatggtaaatgttttagaccttttttgttgtatgagacagagtctcgctcttattgcccaggctggattgcaatggcacgatcttggttcactgtggcctccgcctcccgggttcaagcgattctcttggcctcagcctcccaagtagctgggattacaggcatgtgccaccatgcccagctaaattttgtatttttagtggagatggggtttcaccatgttggccaggctggtttcgaactcctgacctcaggtgatctggcctcctcggcctcccaaagtgctgggattacagatgtgagccaccatgtccagcatgtttcagacctttaaagtgtcagactaagttaatcttcccgagatccagacaagggaaggcctggctgcatcaagcagattctctgcaaatgcaagttttctccaaaaaagacagctttgcagggctgcttcttttggctctctgaacagccatctgaaaatatgacaaatatattttggggtgaaatatttttatttccctcattcgtgttgctggaactggagcactgtcagtttctataatggcatcttacatggcattaaaataattggaatcattctatagcaatctttttgctttcggaatgttctagatcttattccccgctagagttgtagcgttttcctaatactattagttgaaagtcttccacccatgcatatcacctacacattttctaagccgacattcagtgattatttgtcttcaccgaagaatggcttaaagggttaaagatgaaaaatatagggtacggaagggatgtcagatctgaatgatagttgatttatactgtgtaactttcaaaagtagctactcaatgtgagcatttccactgtttttttttttgtttgttttctgagacagagtctcactctgtctcccaggctggagttgcagtggtgcaatgactgcagcacctcctgggcttacacaatcctgcctcagcctcctatatagcagagaacagaggtgcacaccaccatatctggcttattttttgattttttgcagagatgaggtctcactttgttgcccaggctagtctcaaactcctgggctcaagcaatcctcccaccttggcttcccaaagtgctgggattacaggcatgagccactgtgctcagccttcatgttcacttttttaaaatgtatgtattttttatagagatgtgggtctcactgtgtcgcccaggttgtctcgaactcctggtctcaagcgatactcctgctttggcctcccaaaatgctggaatgagcctctgcatacagagttccacatttttatgctccctgagtcatggtctttgaaatctataaatcaataaaggttggaaacagagaagtagacaagaagttatcagtacttctctttagtaacttgtcatttttatccagagtcaagattctcaaaccacacgtgctttgttaaagctggctataaggaaaactggttgcttggctttttcattgagtctatacaaactgctcaaaagaatgactcttaatgaaagcctgagtgaccctcaaattaggaaattctctcccagataattgagaagtggccttgactgtaccaggtcacacatggaaataagtacaaaagtaatgactaaaataggccaagttgaccgagcactttgtacataggggtattatacgactgcaaattgtgtgatgtttaattgtcacagaaagagatactcgttttaagcacttttagcctaatgtactggaaaattgcttaatggatttttatactctattggaaacatttccatattggtgaaatgccactcattcctttttctgaggagcaaatcttgagtagcaatgggaagaaagcctggcaacagccaccatttgtcttgtggacctgacatgcttattcacctagaaaaagaagaaattgctaaatgcacactgatacctcttaggtaaccacaggttttcattttgtgctgaattattagtcatttttcctttatgtttttagagtatgattcagagaccaatttattcccaaagaaaattgccattacatctactaagttttcatattaaaacattttctaccaagggatgactgtcactctgagcaactgtgccactgtgaatgcctcatgtgtcagcatagcttattatctagctctgagcagaatgggagtgctgctgaattagtcttggtccacaggtatctccagtgtcccagatgtttcacctcctttgttcttatctttgcttttattttgggttacaaacacagcagataaattaattctcagcatcttcagagaaactgtgggttagagcagaatcaccaactagaagaaaccatttaaattcaaaaatcataaggaacccagaaccaatgttaacactgcataaatacaacaagattaataggaggccccacagttaattcctaaggtggttcttagctgtaaagcaattcaaatgaccttcttataaaccctgggcaaaagtcccctgtgatgtggtggaaaatatcaacacgtaaaggaaataagaatgactgtgagttgagttttgttgttttagatccagatcatgaatatttaaagaaataaaagcattttgagttgggaggccatgc

SEQ ID NO: 176160 - DNA, 805 bp, Homo sapiens
  Payload ID: 14590
  Gene Symbol: RPP14
  Gene Name: ribonuclease P/MRP 14kDa subunit
  Uniprot ID: O95059
  ENST ID: ENST00000466547
  CDS Start-End: 149-523
agtttctcgggcccagctgtggctgctgccggggagccccaagccttggcgggtccttgcggcgaataggagtctggtcaggcgtcaggctagtccgacgaagagtggccctcttgacttactgtaggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctacc

SEQ ID NO: 176161 - DNA, 525 bp, Homo sapiens
  Payload ID: 14591
  Gene Symbol: RPP21
  Gene Name: ribonuclease P/MRP 21kDa subunit
  Uniprot ID: Q9H633
  ENST ID: ENST00000376642
  CDS Start-End: 14-478
gagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgagatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176162 - DNA, 594 bp, Homo sapiens
  Payload ID: 14591
  Gene Symbol: RPP21
  Gene Name: ribonuclease P/MRP 21kDa subunit
  ENST ID: ENST00000452262
  CDS Start-End: 14-547
gagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176163 - DNA, 594 bp, Homo sapiens; identical to SEQ ID NO: 176162
  Payload ID: 14591
  Gene Symbol: RPP21
  Gene Name: ribonuclease P/MRP 21kDa subunit
  ENST ID: ENST00000439624
  CDS Start-End: 14-547

SEQ ID NO: 176164 - DNA, 594 bp, Homo sapiens; identical to SEQ ID NO: 176162
  Payload ID: 14591
  Gene Symbol: RPP21
  Gene Name: ribonuclease P/MRP 21kDa subunit
  ENST ID: ENST00000422320
  CDS Start-End: 14-547

SEQ ID NO: 176165 - DNA, 594 bp, Homo sapiens
  Payload ID: 14591
  Gene Symbol: RPP21
  Gene Name: ribonuclease P/MRP 21kDa subunit
  Uniprot ID: Q9H633
  ENST ID: ENST00000428040
  CDS Start-End: 14-547
gagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176166 - DNA, 522 bp, Homo sapiens
  Payload ID: 14591
  Gene Symbol: RPP21
  Gene Name: ribonuclease P/MRP 21kDa subunit
  Uniprot ID: Q9H633
  ENST ID: ENST00000436442
  CDS Start-End: 4-438
gtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcaggtgagagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176167 - DNA, 525 bp, Homo sapiens
  Payload ID: 14591
  Gene Symbol: RPP21
  Gene Name: ribonuclease P/MRP 21kDa subunit
  Uniprot ID: Q9H633
  ENST ID: ENST00000414187
  CDS Start-End: 14-478
gagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176168 - DNA, 525 bp, Homo sapiens
  Payload ID: 14591
  Gene Symbol: RPP21
  Gene Name: ribonuclease P/MRP 21kDa subunit
  Uniprot ID: Q9H633
  ENST ID: ENST00000424616
  CDS Start-End: 14-478
gagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176169 - DNA, 577 bp, Homo sapiens
  Payload ID: 14591
  Gene Symbol: RPP21
  Gene Name: ribonuclease P/MRP 21kDa subunit
  ENST ID: ENST00000456870
  CDS Start-End: 42-530
gcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgaccactatcctcctccgcccccagggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176170 - DNA, 522 bp, Homo sapiens
  Payload ID: 14591
  Gene Symbol: RPP21
  Gene Name: ribonuclease P/MRP 21kDa subunit
  Uniprot ID: Q9H633
  ENST ID: ENST00000415583
  CDS Start-End: 4-438
gtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgagatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcaggtgagagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176171 - DNA, 525 bp, Homo sapiens; identical to SEQ ID NO: 176168
  Payload ID: 14591
  Gene Symbol: RPP21
  Gene Name: ribonuclease P/MRP 21kDa subunit
  Uniprot ID: Q9H633
  ENST ID: ENST00000442966
  CDS Start-End: 14-478

SEQ ID NO: 176172 - DNA, 525 bp, Homo sapiens
  Payload ID: 14591
  Gene Symbol: RPP21
  Gene Name: ribonuclease P/MRP 21kDa subunit
  ENST ID: ENST00000418043
  CDS Start-End: 14-478
gagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagacgaagggttccagtaaccagtgatggattcacctcatctcccaaataaagtttacttgttttacattcca

SEQ ID NO: 176173 - DNA, 525 bp, Homo sapiens; identical to SEQ ID NO: 176167
  Payload ID: 14591
  Gene Symbol: RPP21
  Gene Name: ribonuclease P/MRP 21kDa subunit
  Uniprot ID: Q9H633
  ENST ID: ENST00000416977
  CDS Start-End: 14-478

SEQ ID NO: 176174 - DNA, 594 bp, Homo sapiens
  Payload ID: 14591
  Gene Symbol: RPP21
  Gene Name: ribonuclease P/MRP 21kDa subunit
  ENST ID: ENST00000413228
  CDS Start-End: 14-547
gagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagacgaagggttccagtaaccagtgatggattcacctcatctcccaaataaagtttacttgttttacattcca

SEQ ID NO: 176175 - DNA, 522 bp, Homo sapiens
  Payload ID: 14591
  Gene Symbol: RPP21
  Gene Name: ribonuclease P/MRP 21kDa subunit
  ENST ID: ENST00000439797
  CDS Start-End: 4-438
gtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcaggtgagagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176176 - DNA, 577 bp, Homo sapiens
  Payload ID: 14591
  Gene Symbol: RPP21
  Gene Name: ribonuclease P/MRP 21kDa subunit
  Uniprot ID: Q9H633
  ENST ID: ENST00000425575
  CDS Start-End: 42-530
gcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgaccactatcctcctccgcccccagagatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176177 - DNA, 577 bp, Homo sapiens; identical to SEQ ID NO: 176169
  Payload ID: 14591
  Gene Symbol: RPP21
  Gene Name: ribonuclease P/MRP 21kDa subunit
  ENST ID: ENST00000412659
  CDS Start-End: 42-530

SEQ ID NO: 176178 - DNA, 522 bp, Homo sapiens; identical to SEQ ID NO: 176166
  Payload ID: 14591
  Gene Symbol: RPP21
  Gene Name: ribonuclease P/MRP 21kDa subunit
  Uniprot ID: Q9H633
  ENST ID: ENST00000437470
  CDS Start-End: 4-438

SEQ ID NO: 176179 - DNA, 577 bp, Homo sapiens
  Payload ID: 14591
  Gene Symbol: RPP21
  Gene Name: ribonuclease P/MRP 21kDa subunit
  Uniprot ID: Q9H633
  ENST ID: ENST00000455025
  CDS Start-End: 42-530
gcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgaccactatcctcctccgcccccagggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176180 - DNA, 577 bp, Homo sapiens; identical to SEQ ID NO: 176179
  Payload ID: 14591
  Gene Symbol: RPP21
  Gene Name: ribonuclease P/MRP 21kDa subunit
  Uniprot ID: Q9H633
  ENST ID: ENST00000433076
  CDS Start-End: 42-530

SEQ ID NO: 176181 - DNA, 522 bp, Homo sapiens; identical to SEQ ID NO: 176175
  Payload ID: 14591
  Gene Symbol: RPP21
  Gene Name: ribonuclease P/MRP 21kDa subunit
  ENST ID: ENST00000427637
  CDS Start-End: 4-438

SEQ ID NO: 176182 - DNA, 522 bp, Homo sapiens
  Payload ID: 14591
  Gene Symbol: RPP21
  Gene Name: ribonuclease P/MRP 21kDa subunit
  Uniprot ID: Q9H633
  ENST ID: ENST00000435318
  CDS Start-End: 4-438
gtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcaggtgagagattccaaaccactacaacccttgccaaacacagcccactccatttcagaccgccttcctgaggagaaaatgcagacgaagggttccagtaaccagtgatggattcacctcatctcccaaataaagtttacttgttttacattcca

SEQ ID NO: 176183 - DNA, 579 bp, Homo sapiens
  Payload ID: 14591
  Gene Symbol: RPP21
  Gene Name: ribonuclease P/MRP 21kDa subunit
  ENST ID: ENST00000411515
  CDS Start-End: 44-532
gcgaggggtggggcgctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgaccactatcctcctccgcccccagggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagacgaagggttccagtaaccagtgatggattcacctcatctcccaaataaagtttacttgttttacattcca

SEQ ID NO: 176184 - DNA, 522 bp, Homo sapiens; identical to SEQ ID NO: 176175
  Payload ID: 14591
  Gene Symbol: RPP21
  Gene Name: ribonuclease P/MRP 21kDa subunit
  ENST ID: ENST00000422720
  CDS Start-End: 4-438

SEQ ID NO: 176185 - DNA, 594 bp, Homo sapiens; identical to SEQ ID NO: 176165
  Payload ID: 14591
  Gene Symbol: RPP21
  Gene Name: ribonuclease P/MRP 21kDa subunit
  Uniprot ID: Q9H633
  ENST ID: ENST00000411784
  CDS Start-End: 14-547

SEQ ID NO: 176186 - DNA, 525 bp, Homo sapiens; identical to SEQ ID NO: 176167
  Payload ID: 14591
  Gene Symbol: RPP21
  Gene Name: ribonuclease P/MRP 21kDa subunit
  Uniprot ID: Q9H633
  ENST ID: ENST00000434282
  CDS Start-End: 14-478

SEQ ID NO: 176187 - DNA, 594 bp, Homo sapiens
  Payload ID: 14591
  Gene Symbol: RPP21
  Gene Name: ribonuclease P/MRP 21kDa subunit
  Uniprot ID: Q9H633
  ENST ID: ENST00000430900
  CDS Start-End: 14-547
gagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcgagatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 176188 - DNA, 577 bp, Homo sapiens; identical to SEQ ID NO: 176169
  Payload ID: 14591
  Gene Symbol: RPP21
  Gene Name: ribonuclease P/MRP 21kDa subunit
  ENST ID: ENST00000430819
  CDS Start-End: 42-530

SEQ ID NO: 176189 - DNA, 3049 bp, Homo sapiens
  Payload ID: 14592
  Gene Symbol: RPP25
  Gene Name: ribonuclease P/MRP 25kDa subunit
  Uniprot ID: Q9BUL9
  ENST ID: ENST00000322177
  CDS Start-End: 882-1481
cttttcagaagaggtcacgcccgcttccccacgcgcctcggggaacagcctggcccaaagcctcactcctcacgtcccaggggtggacgggggtccgggagcctcgagctccgggcaggcgtggcgaggctgaagtctgggtcttccgcgccccgcgaggaccacgccgcgacgtaatcgcccgcggggaggcgcggagtggagccgcagccagctcctcccgcactctgctgaccgcgcactagctgtccttgaggcaagaatacttgggagcggaaaaaaggtgggggtgttccccggggcgggggaggaggggcaaggccccagcaagcctcttggaaatctctccctgggaggggacgaggggcggccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaaatggctgtgtcccccattttttttctaaccacccgcctgtgcagagacagctctcgcctggccccttgtgtctcccctcccctccagccttgcgtcctgagtctttggagtcttcagggtcaggcacagagactgaacagcttcaaaatggtgcaaggcactgcccagtccctggcttcttcctctctcctcccccactccgccctcccgggctggccctggcctcagaggctgttgcaaatgggggcccgtgtacccctgtacatcgccactaagggaaagggagcggcacattgtttttctgggaggggaaggaaggagtggaaggacagcatcgatgaactctcctggaggtcactgcaaagggtggcagaccctgctgaggtccctgaatctgcagcctccagacaataaactgaaccttacccagaaggctggcacaaagcccccagctctgtgggtaggatctccccttcactgccctctctctgagaaaggacagcacacccttgggaaagggggaggagagagactgagcacaaatccactgctggaaattactattcagcagagaagctgggtcttgggctgtgaatcactgcaggcctcctgataagctgctgcctccagccctgcacagctgtctgttgagagataacagcctcataagcttctctgcccaactccaagccagctggggggtgggggtgctgctgtgtgctggaagagctctggtgagttgggggtggcatacagccccaggatctcagaagcagatctcatcccatgcaactcagcagcacccctggaaagggggagatgcggaagaatgtatttataagtcattttgctggcagaaccctgaaataaatcctgctggtgacaagaga

SEQ ID NO: 176190 - DNA, 1092 bp, Homo sapiens
  Payload ID: 14593
  Gene Symbol: RPP25L
  Gene Name: ribonuclease P/MRP 25kDa subunit-like
  Uniprot ID: Q8N5L8
  ENST ID: ENST00000297613
  CDS Start-End: 282-773
gcgcgccatcttggctccggatcgtgcgtgaggcggcttcggtgagagccggaaccgggcgggcagaggggcgctcgtagggttgggggacgcctgtggcttggctgcagcggccggcaagaccctggaagagaccgtggctatggaaacggccaaggctgtcttggaatgtcctgagcagccctccgagtcgagcctctgcccccgagtttctgagtgacctgggttgatatagattgaccttgtgggcagcgagagtcacagacaagacagcaagcaggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtcccaggcctgcaccagctcaccaagctacgtttccttcagactgaggacagctgggtcccagcctcacctgacacagggctagaccccctcacagtgcgccgccatgtgcctgcagtgtgggtgctgctcagccgggaccccctggaccccaatgagtgtggttaccaacccccaggagcaccccctggcctgggttccatgcccagctccagctgtggccctcgttcccgaagaagggctcgagacacccgatcgtgaagacctgctgagccagcctgttctccgggcctgaatgtctggggtgcttgtgccttttctgagaagcgttgtgactgctcaacatccccatcaaggtttgagtccacaaaagtggacctccctatcatgcttccccttccctctagcatgtgggaagggactgctgtgaagaatgacagatgtggggcctctgccaagttctgcattgctaaataagggcttcctctgccttctacctacagtgcatttgaactgccttctgaaagaggtccagggagggatttaggaaataaagtttctacctatttgatgagcctct

SEQ ID NO: 176191 - DNA, 888 bp, Homo sapiens
  Payload ID: 14593
  Gene Symbol: RPP25L
  Gene Name: ribonuclease P/MRP 25kDa subunit-like
  Uniprot ID: Q8N5L8
  ENST ID: ENST00000378959
  CDS Start-End: 78-569
gcgcgccatcttggctccggatcgtgcgtgaggcggcttcgtgggcagcgagagtcacagacaagacagcaagcaggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtcccaggcctgcaccagctcaccaagctacgtttccttcagactgaggacagctgggtcccagcctcacctgacacagggctagaccccctcacagtgcgccgccatgtgcctgcagtgtgggtgctgctcagccgggaccccctggaccccaatgagtgtggttaccaacccccaggagcaccccctggcctgggttccatgcccagctccagctgtggccctcgttcccgaagaagggctcgagacacccgatcgtgaagacctgctgagccagcctgttctccgggcctgaatgtctggggtgcttgtgccttttctgagaagcgttgtgactgctcaacatccccatcaaggtttgagtccacaaaagtggacctccctatcatgcttccccttccctctagcatgtgggaagggactgctgtgaagaatgacagatgtggggcctctgccaagttctgcattgctaaataagggcttcctctgccttctacctacagtgcatttgaactgccttctgaaagaggtccagggagggatttaggaaataaagtttctacctatttgatgagcctct

SEQ ID NO: 176192 - DNA, 767 bp, Homo sapiens
  Payload ID: 14594
  Gene Symbol: RPP30
  Gene Name: ribonuclease P/MRP 30kDa subunit
  ENST ID: ENST00000277882
  CDS Start-End: 5-767
cagcatggcggtgtttgcagatttggacctgcgagcgggttctgacctgaaggctctgcgcggacttgtggagacagccgctcaccgtgagttgccccggcttcgcgcctggccaacctcatgccacccagaccatcgggccacactccggattggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggag

SEQ ID NO: 176193 - DNA, 2589 bp, Homo sapiens
  Payload ID: 14594
  Gene Symbol: RPP30
  Gene Name: ribonuclease P/MRP 30kDa subunit
  Uniprot ID: P78346
  ENST ID: ENST00000371703
  CDS Start-End: 272-1078
ggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagt

SEQ ID NO: 176194 - DNA, 1004 bp, Homo sapiens
  Payload ID: 14594
  Gene Symbol: RPP30
  Gene Name: ribonuclease P/MRP 30kDa subunit
  Uniprot ID: P78346
  ENST ID: ENST00000413330
  CDS Start-End: 36-1004
agactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttga

SEQ ID NO: 176195 - DNA, 726 bp, Homo sapiens
  Payload ID: 14594
  Gene Symbol: RPP30
  Gene Name: ribonuclease P/MRP 30kDa subunit
  ENST ID: ENST00000414836
  CDS Start-End: 1-639
gaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgattta

SEQ ID NO: 176196 - DNA, 1457 bp, Homo sapiens
  Payload ID: 14595
  Gene Symbol: RPP38
  Gene Name: ribonuclease P/MRP 38kDa subunit
  Uniprot ID: P78345
  ENST ID: ENST00000378197
  CDS Start-End: 515-1366
accacggattcgccatcgtgagttccaggtgggcgcgcggggcccacgtagggcaggaggccagccccggggggatcgggcccgggactctgcggaatctggaggccgaagcccgcgcgcacgcagggtctctgctgcttccccaacgcctgttgcgtggccgcaggacccgccgccctcccggttgggccgcccagtcccgggccgggcgcgtgcacccagagcttccgcgtttctagtccggctcctctgctggattgcagcgccggctgggcaccaggagtacaaagcgaaaacccccgccggcccttctgttctccacggtctccaaggagacacggacaacagaacaacacttccgtgtgctaaatagtaaagcaccaagacagggtcagatgtgttactgggctggagtgtggtggcacaatcacgctcactgcatccttgacctcctgggctcaagtgatcttcccacctcagcctcccaagtagctgggactacaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatacttacataga

SEQ ID NO: 176197 - DNA, 833 bp, Homo sapiens
  Payload ID: 14595
  Gene Symbol: RPP38
  Gene Name: ribonuclease P/MRP 38kDa subunit
  ENST ID: ENST00000378201
  CDS Start-End: 325-762
ggccgctttcccctctccggagtgacctaacacaggataacgaaacctgcactgctccgagcgcttcctccccggcccgtcgcgtctgcgaggcgaggccgggaggcgagggctctgcgcacgcgcggcgcaggcgcactgggcgccggtgctgttgccttcaggtgaccacggattcgccatcgtgagttccagacagggtcagatgtgttactgggctggagtgtggtggcacaatcacgctcactgcatccttgacctcctgggctcaagtgatcttcccacctcagcctcccaagtagctgggactacaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctgtttcactcttgttgtccaggctggagtgcagtggtgtgatcccggctcactgcaaccccgcctcctgggttcaagcgattctcctgcctcagcctcctgaatagctggga

SEQ ID NO: 176198 - DNA, 1030 bp, Homo sapiens
  Payload ID: 14595
  Gene Symbol: RPP38
  Gene Name: ribonuclease P/MRP 38kDa subunit
  Uniprot ID: P78345
  ENST ID: ENST00000378202
  CDS Start-End: 90-941
gcgcacgcgcggcgcaggcgcactgggcgccggtgctgttgccttcaggtgaccacggattcgccatcgtgagttccaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatacttacata

SEQ ID NO: 176199 - DNA, 1296 bp, Homo sapiens
  Payload ID: 14595
  Gene Symbol: RPP38
  Gene Name: ribonuclease P/MRP 38kDa subunit
  Uniprot ID: P78345
  ENST ID: ENST00000378203
  CDS Start-End: 360-1211
ctcgttgtgtcgtttccgggtcgcgcgacgctgtgggccgctttcccctctccggagtgacctaacacaggataacgaaacctgcactgctccgagcgcttcctccccggcccgtcgcgtctgcgaggcgaggccgggaggcgagggctctgcgcacgcgcggcgcaggcgcactgggcgccggtgctgttgccttcaggtgaccacggattcgccatcgtgagttccagacagggtcagatgtgttactgggctggagtgtggtggcacaatcacgctcactgcatccttgacctcctgggctcaagtgatcttcccacctcagcctcccaagtagctgggactacaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatactta

SEQ ID NO: 176200 - DNA, 863 bp, Homo sapiens
  Payload ID: 14595
  Gene Symbol: RPP38
  Gene Name: ribonuclease P/MRP 38kDa subunit
  ENST ID: ENST00000441850
  CDS Start-End: 358-863
ggggcccacgtagggcaggaggccagccccggggggatcgggcccgggactctgcggaatctggaggccgaagcccgcgcgcacgcagggtctctgctgcttccccaacgcctgttgcgtggccgcaggacccgccgccctcccggttgggccgcccagtcccgggccgggcgcgtgcacccagagcttccgcgtttctagtccggctcctctgctggattgcagcgccggctgggcaccaggagtacaaagcgaaaacccccgccggcccttctgttctccacggtctccaaggagacacggacaacagaacaacacttccgtgtgctaaatagtaaagcaccaaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgc

SEQ ID NO: 176201 - DNA, 1537 bp, Homo sapiens
  Payload ID: 14595
  Gene Symbol: RPP38
  Gene Name: ribonuclease P/MRP 38kDa subunit
  Uniprot ID: P78345
  ENST ID: ENST00000616640
  CDS Start-End: 598-1449
ctcgttgtgtcgtttccgggtcgcgcgacgctgtgggccgctttcccctctccggagtgacctaacacaggataacgaaacctgcactgctccgagcgcttcctccccggcccgtcgcgtctgcgaggcgaggccgggaggcgagggctctgcgcacgcgcggcgcaggcgcactgggcgccggtgctgttgccttcaggtgaccacggattcgccatcgtgagttccaggtgggcgcgcggggcccacgtagggcaggaggccagccccggggggatcgggcccgggactctgcggaatctggaggccgaagcccgcgcgcacgcagggtctctgctgcttccccaacgcctgttgcgtggccgcaggacccgccgccctcccggttgggccgcccagtcccgggccgggcgcgtgcacccagagcttccgcgtttctagtccggctcctctgctggattgcagcgccggctgggcaccaggagtacaaagcgaaaacccccgccggcccttctgttctccacggtctccaaggagacacggacaacagaacaacacttccgtgtgctaaatagtaaagcaccaaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatacttacat

SEQ ID NO: 176202 - DNA, 1088 bp, Homo sapiens
  Payload ID: 14596
  Gene Symbol: RPP40
  Gene Name: ribonuclease P/MRP 40kDa subunit
  Uniprot ID: O75818
  ENST ID: ENST00000319533
  CDS Start-End: 35-1057
gcggaggccgggaggaccaggaacccaggagagcatggccacgctgcgccggcttcgggaggcgccgcggcacttactggtttgcgagaaatccaacttcggcaaccacaagtcgcgccaccggcatcttgtgcagacgcactactataactacagggtttcatttctcattcctgaatgtgggatactatcggaagaactgaaaaacctggtcatgaacactggaccctattactttgtgaagaatttacctcttcatgaattaattacacctgaattcatcagtacctttataaagaaagggaaattaattttgtcactggataaagacacttatgaagaaactggacttcagggtcatccatctcagttttctggcagaaaaattatgaaatttattgtttccattgatttgatggaattatccttaaacttggattctaagaagtatgaaagaatatcttggtctttcaaagaaaagaagccattgaaatttgattttcttttggcttggcataaaacaggttcagaagaatcgacaatgatgtcatatttttccaagtaccaaattcaggagcatcagccaaaagtagcactgagcacgttgagagatctccagtgcccagtgctgcagagcagcgagctggagggaacgccagaggtgtcctgccgggctctggagctcttcgactggctcggcgccgtcttcagtaatgtcgacctaaataatgagcctaataatttcatatcaacctattgctgtcctgagccaagcacagtggtggcaaaagcttatttgtgtacaatcactggcttcatacttccagagaagatctgtctcctattggaacatctctgtcactactttgatgaaccgaagttagctccatgggttacactgtccgttcaaggctttgcagacagccctgtttcttgggaaaaaaatgaacatggttttcgaaaaggaggagaacatttatataactttgtgatttttaataatcaggactattggcttcagatggctgttggggcaaatgatcactgtccaccataaaaaataaaaattaaaaatcgtgtttacttac

SEQ ID NO: 176203 - DNA, 1483 bp, Homo sapiens
  Payload ID: 14596
  Gene Symbol: RPP40
  Gene Name: ribonuclease P/MRP 40kDa subunit
  Uniprot ID: O75818
  ENST ID: ENST00000380051
  CDS Start-End: 46-1137
gtgccccgccagcggaggccgggaggaccaggaacccaggagagcatggccacgctgcgccggcttcgggaggcgccgcggcacttactggtttgcgagaaatccaacttcggcaaccacaagtcgcgccaccggcatcttgtgcagacgcactactataactacagggtttcatttctcattcctgaatgtgggatactatcggaagaactgaaaaacctggtcatgaacactggaccctattactttgtgaagaatttacctcttcatgaattaattacacctgaattcatcagtacctttataaagaaaggttcttgctatgcactaacatacaatacacatattgatgaagataatactgttgccctgctaccaaatgggaaattaattttgtcactggataaagacacttatgaagaaactggacttcagggtcatccatctcagttttctggcagaaaaattatgaaatttattgtttccattgatttgatggaattatccttaaacttggattctaagaagtatgaaagaatatcttggtctttcaaagaaaagaagccattgaaatttgattttcttttggcttggcataaaacaggttcagaagaatcgacaatgatgtcatatttttccaagtaccaaattcaggagcatcagccaaaagtagcactgagcacgttgagagatctccagtgcccagtgctgcagagcagcgagctggagggaacgccagaggtgtcctgccgggctctggagctcttcgactggctcggcgccgtcttcagtaatgtcgacctaaataatgagcctaataatttcatatcaacctattgctgtcctgagccaagcacagtggtggcaaaagcttatttgtgtacaatcactggcttcatacttccagagaagatctgtctcctattggaacatctctgtcactactttgatgaaccgaagttagctccatgggttacactgtccgttcaaggctttgcagacagccctgtttcttgggaaaaaaatgaacatggttttcgaaaaggaggagaacatttatataactttgtgatttttaataatcaggactattggcttcagatggctgttggggcaaatgatcactgtccaccataaaaaataaaaattaaaaatcgtgtttacttacatttacgcttgctttcagatttcttaatggtaaaaggtctgtgtgtccactcaggcttgtgtgatggtgacatttctcagatcagcatttgctggcatcctgccctgcacctgagacccatctgtgatggcagcaaggcctgctgtccagtgaatagctcatagttgatttctctctgtcaacataagcacagggttgtgggttactatgtggtacactgggccaggatgtccagggaccggggatattggtccccatctcactccattggttgagatatattttgttcattacaactttttcagataataaaaa

SEQ ID NO: 176204 - DNA, 500 bp, Homo sapiens
  Payload ID: 14596
  Gene Symbol: RPP40
  Gene Name: ribonuclease P/MRP 40kDa subunit
  ENST ID: ENST00000479782
  CDS Start-End: 17-358
aggaacccaggagagcatggccacgctgcgccggcttcgggaggcgccgcggcacttactggtttgcgagaaatccaacttcggcaaccacaagtcgcgccaccggcatcttgtgcagacgcactactataactacagggtttcatttctcattcctgaatgtgggatactatcggaagaactgaaaaacctggtcatgaacactggaccctattactttgtgaagaatttacctcttcatgaattaattacacctgaattcatcagtacctttataaagaaagaattctactttggacccctctccgcgcatccccaaaggttcttgctatgcactaacatacaatacacatattgatgaagataatactgttgccctgctaccaaatgggaaattaattttgtcactggataaagacacttatgaagaaactggacttcagggtcatccatctcagttttctggcagaaaaattatgaaatttattgtttccattgat

SEQ ID NO: 176205 - DNA, 1042 bp, Homo sapiens
  Payload ID: 14596
  Gene Symbol: RPP40
  Gene Name: ribonuclease P/MRP 40kDa subunit
  ENST ID: ENST00000464646
  CDS Start-End: 131-1042
ggtacccagtctggagggagctgttgtcaggggcgttctggctgctcactcgtgtcaacccgccgaactgggagtttcatttctcattcctgaatgtgggatactatcggaagaactgaaaaacctggtcatgaacactggaccctattactttgtgaagaatttacctcttcatgaattaattacacctgaattcatcagtacctttataaagaaaggttcttgctatgcactaacatacaatacacatattgatgaagataatactgttgccctgctaccaaatgggaaattaattttgtcactggataaagacacttatgaagaaactggacttcagggtcatccatctcagttttctggcagaaaaattatgaaatttattgtttccattgatttgatggaattatccttaaacttggattctaagaagtatgaaagaatatcttggtctttcaaagaaaagaagccattgaaatttgattttcttttggcttggcataaaacaggttcagaagaatcgacaatgatgtcatatttttccaagtaccaaattcaggagcatcagccaaaagtagcactgagcacgttgagagatctccagtgcccagtgctgcagagcagcgagctggagggaacgccagaggtgtcctgccgggctctggagctcttcgactggctcggcgccgtcttcagtaatgtcgacctaaataatgagcctaataatttcatatcaacctattgctgtcctgagccaagcacagtggtggcaaaagcttatttgtgtacaatcactggcttcatacttccagagaagatctgtctcctattggaacatctctgtcactactttgatgaaccgaagttagctccatgggttacactgtccgttcaaggctttgcagacagccctgtttcttgggaaaaaaatgaacatggttttcgaaaaggaggagaacatttatataactttgtgatttttaataatcaggactattggcttcagatggctgttggggcaaatgatcactgtccaccataa

SEQ ID NO: 176206 - DNA, 1056 bp, Homo sapiens
  Payload ID: 14596
  Gene Symbol: RPP40
  Gene Name: ribonuclease P/MRP 40kDa subunit
  ENST ID: ENST00000618533
  CDS Start-End: 62-1027
gaggaaggggcggggcgtgccccgccagcggaggccgggaggaccaggaacccaggagagcatggccacgctgcgccggcttcgggaggcgccgcggcacttactggtttgcgagaaatccaacttcggcaaccacaagtcgcgccaccggcatcttgtgcagacgcactactataactacagggtttcatttctcattcctgaatgtgggatactatcggaagaactgaaaaacctggtcatgaacactggaccctattactttgtgaagaatttacctcttcatgaattaattacacctgaattcatcagtacctttataaagaaaggttcttgctatgcactaacatacaatacacatattgatgaagataatactgttgccctgctaccaaatgggaaattaattttgtcactggataaagacacttatgaagaaactggacttcagggtcatccatctcagttttctggcagaaaaattatgaaatttagttcagaagaatcgacaatgatgtcatatttttccaagtaccaaattcaggagcatcagccaaaagtagcactgagcacgttgagagatctccagtgcccagtgctgcagagcagcgagctggagggaacgccagaggtgtcctgccgggctctggagctcttcgactggctcggcgccgtcttcagtaatgtcgacctaaataatgagcctaataatttcatatcaacctattgctgtcctgagccaagcacagtggtggcaaaagcttatttgtgtacaatcactggcttcatacttccagagaagatctgtctcctattggaacatctctgtcactactttgatgaaccgaagttagctccatgggttacactgtccgttcaaggctttgcagacagccctgtttcttgggaaaaaaatgaacatggttttcgaaaaggaggagaacatttatataactttgtgatttttaataatcaggactattggcttcagatggctgttggggcaaatgatcactgtccaccataaaaaataaaaattaaaaatcgtgtttactt

SEQ ID NO: 176207 - DNA, 1220 bp, Homo sapiens
  Payload ID: 14597
  Gene Symbol: RNASET2
  Gene Name: ribonuclease T2
  ENST ID: ENST00000028008
  CDS Start-End: 403-618
ctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcaagcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaa

SEQ ID NO: 176208 - DNA, 1924 bp, Homo sapiens
  Payload ID: 14597
  Gene Symbol: RNASET2
  Gene Name: ribonuclease T2
  Uniprot ID: O00584
  ENST ID: ENST00000421787
  CDS Start-End: 362-727
gcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaagaaaaattggatggagattacagacagttcactcccttccccctcaactctcccaatcattaacatcttctatagtgtgttacatttgttacaattaatgaactgatactgatactttattattaaataaagtttagcattaacattagggtttactcctgtgttgtgcggctttggacaaatgcaggagagcaagtcccacccagtgtgctctggagcagccgctggccctaaaccccctgagccatacctccccttcttcctccccttgaacccccaagcaaccgcgaatctcattcctgtctcttaagactaccttttccaaattgtcacgtcgttggaatcatacagtatgtagcctctgcagactggcttcttgcacttagcaatgtatgtttgcagttcctccagtgtcttttcatgactcgacggctcattggtttttgttgctgaaaatattccattgtttggatgtacactttatcccttcacctataacagcttgtattttcgtgtgcagttttatgattactcaaattgcacttgtagatatatcttaacaaacacttcatacaaaataagcataggattattttattcaccaaagtattgttaattagcagagctcaattctttggtgtcagtttatcaaatttaccttctaggttttgagtttattattaagaacctgcgtagacttattttattttttaatgcataggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaa

SEQ ID NO: 176209 - DNA, 887 bp, Homo sapiens
  Payload ID: 14597
  Gene Symbol: RNASET2
  Gene Name: ribonuclease T2
  Uniprot ID: O00584
  ENST ID: ENST00000476238
  CDS Start-End: 69-839
ttggtgctcccagcacctagcaccgggagactggagaggtttccaggagagtgacccgagtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcac

SEQ ID NO: 176210 - DNA, 1417 bp, Homo sapiens
  Payload ID: 14597
  Gene Symbol: RNASET2
  Gene Name: ribonuclease T2
  ENST ID: ENST00000366855
  CDS Start-End: 677-1333
gtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgactgctcccagcctaggacgcgacaaagcaggtggcaggcttggtggagcactgttcctgcactcgaagttctctcagaggtcgaagaagtcgtggaggggacacttaatttcagctttcactgcggcgggtgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaa

SEQ ID NO: 176211 - DNA, 963 bp, Homo sapiens
  Payload ID: 14597
  Gene Symbol: RNASET2
  Gene Name: ribonuclease T2
  ENST ID: ENST00000478180
  CDS Start-End: 203-963
caggagagtgacccgagtaggtcccctcctaattctggagccgtccctcgggctgcgcagtggagcgccgaggtggcgggaggctgcggggagcctgggcggccaagcaccatctgcagtcaggagctcccgggcagcttgcagggcgcagtttttgaaagcgggtgctgcgtgcggaccgcgggcctgcagggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagac

SEQ ID NO: 176212 - DNA, 1375 bp, Homo sapiens
  Payload ID: 14597
  Gene Symbol: RNASET2
  Gene Name: ribonuclease T2
  Uniprot ID: O00584
  ENST ID: ENST00000508775
  CDS Start-End: 521-1291
ctgcctcggcctctctgagccaaccacggggcggggcgtgaacgccgggcggggacgtgccgttctggggggcgtgtccaccggcgggggcgtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaa

SEQ ID NO: 176213 - DNA, 1124 bp, Homo sapiens
  Payload ID: 14597
  Gene Symbol: RNASET2
  Gene Name: ribonuclease T2
  ENST ID: ENST00000611959
  CDS Start-End: 408-1124
ctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaagaaaaattggatggagattacagacagttcactcccttcccccagcatgggacctgcgccgcccaggtggatgcgctcaactcccagaagaagtactttggcagaagcctggaactctacagggagctggacctcaacaggtgggtgcgcccttcccccggctgcacttcccagtggggatctctgctgtcgcccaagcctgacagctggatccaggggagtgggtgtagacctcactgccctccagcagcttctgcatgtgcactattcggctactgggatcattcctgaggaatgttctgagcctaccaagcctttccagatcattctacatcacgatcacacagagtgggtgcagagtattgggatgcccatctggaccatctcatcatcagagtcggccatagggaaaacgaggactcaaccagcatgtgccgttctcagccatgattcctga

SEQ ID NO: 176214 - DNA, 1391 bp, Homo sapiens
  Payload ID: 14597
  Gene Symbol: RNASET2
  Gene Name: ribonuclease T2
  ENST ID: ENST00000620173
  CDS Start-End: 408-1328
ctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggtattgacttttaattatatttctactgcagagtgctcctcacacagactctcctcctctcctccgggactcactgcagggaatggtttctggggagggtcagaggaaaggtgtggacgtggatggccaatgtttttagaacagataaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttct

SEQ ID NO: 176215 - DNA, 878 bp, Homo sapiens
  Payload ID: 14598
  Gene Symbol: RNASE1
  Gene Name: ribonuclease, RNase A family, 1 (pancreatic)
  Uniprot ID: P07998
  ENST ID: ENST00000340900
  CDS Start-End: 156-626
gctgagtgattgcagaaactggccttccatctctctcagacaccaagctgcagatccaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaacacctgatttctgaagc

SEQ ID NO: 176216 - DNA, 1348 bp, Homo sapiens
  Payload ID: 14598
  Gene Symbol: RNASE1
  Gene Name: ribonuclease, RNase A family, 1 (pancreatic)
  Uniprot ID: P07998
  ENST ID: ENST00000397967
  CDS Start-End: 508-978
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaacacctgatttctgaagcggttctgtctaggtactgtttctggcattgccttccagcaaggggtaagaactgtaaatctgattcactttggagaacggtgaatggagtaattaaatgccttcccttctgacttgga

SEQ ID NO: 176217 - DNA, 769 bp, Homo sapiens
  Payload ID: 14598
  Gene Symbol: RNASE1
  Gene Name: ribonuclease, RNase A family, 1 (pancreatic)
  Uniprot ID: P07998
  ENST ID: ENST00000397970
  CDS Start-End: 161-631
gattgcagaaactggccttccatctctctcagacaccaagctgcagatccaggtcactttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgag

SEQ ID NO: 176218 - DNA, 896 bp, Homo sapiens
  Payload ID: 14598
  Gene Symbol: RNASE1
  Gene Name: ribonuclease, RNase A family, 1 (pancreatic)
  Uniprot ID: P07998
  ENST ID: ENST00000412779
  CDS Start-End: 184-654
ttgagcactgggtacaaatgtattttggatcaaagaaactccagtattcaaagataggaactgacaggattttaggtcactttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaacacctga

SEQ ID NO: 176219 - DNA, 655 bp, Homo sapiens
  Payload ID: 14598
  Gene Symbol: RNASE1
  Gene Name: ribonuclease, RNase A family, 1 (pancreatic)
  ENST ID: ENST00000555698
  CDS Start-End: 101-451
gattgcagaaactggccttccatctctctcagacaccaagctgcagatccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctcc

SEQ ID NO: 176220 - DNA, 717 bp, Homo sapiens
  Payload ID: 14599
  Gene Symbol: RNASE10
  Gene Name: ribonuclease, RNase A family, 10 (non-active)
  Uniprot ID: Q5GAN6
  ENST ID: ENST00000328444
  CDS Start-End: 20-670
cgcttcctctccaggcaaaatgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatgaagcaactcatcatcttttttctcttcaccttctcctgttcctcttcc

SEQ ID NO: 176221 - DNA, 1172 bp, Homo sapiens
  Payload ID: 14599
  Gene Symbol: RNASE10
  Gene Name: ribonuclease, RNase A family, 10 (non-active)
  Uniprot ID: Q5GAN6
  ENST ID: ENST00000430083
  CDS Start-End: 405-1139
agctcctaaccgcgagtgatccgccagccttggcctcccaaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcctggccgccaccccgtctgggaagtgaggagcgtctctgcctggccgcccatcgtctgggatacgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggcaaaatgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatgaagcaactcatcatcttttttctcttcaccttct

SEQ ID NO: 176222 - DNA, 872 bp, Homo sapiens
  Payload ID: 14600
  Gene Symbol: RNASE11
  Gene Name: ribonuclease, RNase A family, 11 (non-active)
  Uniprot ID: Q8TAA1
  ENST ID: ENST00000398008
  CDS Start-End: 189-788
gagcaggcatgggtgggtcacaggctttggagagcactctctgtcctgatcttttcagttgagagacttcagctgttcattgctcatttggacttagttcaagaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatcta

SEQ ID NO: 176223 - DNA, 1034 bp, Homo sapiens
  Payload ID: 14600
  Gene Symbol: RNASE11
  Gene Name: ribonuclease, RNase A family, 11 (non-active)
  Uniprot ID: Q8TAA1
  ENST ID: ENST00000398009
  CDS Start-End: 256-855
agctatggcatttcaatcctgtatgtgagagctagagactcatacagtgacctagagcaggcatggaattttgggtgtcaccaggtaaacagagccctcagcatctgaatagaaactgaacaggaacagttagacacaacagcagaaactcccaggaaacaaacacgatttcacttttagctctgcaacaaagtggaatcttcctctacaggatcaacttgccgaaggaactgaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactga

SEQ ID NO: 176224 - DNA, 946 bp, Homo sapiens
  Payload ID: 14600
  Gene Symbol: RNASE11
  Gene Name: ribonuclease, RNase A family, 11 (non-active)
  Uniprot ID: Q8TAA1
  ENST ID: ENST00000432835
  CDS Start-End: 347-946
ctagagactcatacagtgacctagagcaggcatgggtgggtcacaggctttggagagcactctctgtcctgatcttttcagttgagagacttcagctgttcattgctcatttggacttagttcaaggtcatgtcaaagaagaaggtgcacttacgctagttgttagctctgtcttttgtaaccatcaagttccatgcgattgatcagatttaggagggggcgttgggggataatcgtaagtgaaggacagtttgcaaccttaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaa

SEQ ID NO: 176225 - DNA, 850 bp, Homo sapiens
  Payload ID: 14600
  Gene Symbol: RNASE11
  Gene Name: ribonuclease, RNase A family, 11 (non-active)
  ENST ID: ENST00000443456
  CDS Start-End: 315-850
actcatacagtgacctagagcaggcatgggtgggtcacaggctttggagagcactctctgtcctgatcttttcagttgagagacttcagctgttcattgctcatttggacttagttcaaggtcatgtcaaagaagaaggtgcacttacgctagttgttagctctgtcttttgtaaccatcaagttccatgcgattgatcagatttaggagggggcgttgggggataatcaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaa

SEQ ID NO: 176226 - DNA, 791 bp, Homo sapiens
  Payload ID: 14600
  Gene Symbol: RNASE11
  Gene Name: ribonuclease, RNase A family, 11 (non-active)
  ENST ID: ENST00000413502
  CDS Start-End: 364-791
agccccgtgccaggcaaggcgggtcaccgggcagcgtcggggccctcttctgcctcggggtctcttcacggagggcgccctgcggcgacagctttcgccggccgcgcgcacggcggtcggtacctgttaaggacgagatgccttccgaccaccggataactcgggacggtccctgatttgcctgctccctgtccaacagcatcttcggctcactcggaagtgaaaacatgcaatttcatgttataacatgcaatttcatgtcataaattattcccactgacgcctgaacatttttcctaaaagggatctgcagtcacaaggcgccgccttccggaatttagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcc

SEQ ID NO: 176227 - DNA, 1101 bp, Homo sapiens
  Payload ID: 14600
  Gene Symbol: RNASE11
  Gene Name: ribonuclease, RNase A family, 11 (non-active)
  Uniprot ID: Q8TAA1
  ENST ID: ENST00000553849
  CDS Start-End: 186-785
actcatctcatggcttcttccatcttaggtggccgtttttcagctgagtttcattttctagttctctgtggtaattctgttgtcattgttgtctccatagaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgatactggcgtgcagattcttctctctctatctctctctctgtgtggggggagggtggggagggtgtaaaacaaactgaatttcatcctagctcagctataaagccaagaaacagaatccacctaactaggcagaatta

SEQ ID NO: 176228 - DNA, 527 bp, Homo sapiens
  Payload ID: 14600
  Gene Symbol: RNASE11
  Gene Name: ribonuclease, RNase A family, 11 (non-active)
  ENST ID: ENST00000554842
  CDS Start-End: 119-527
gtcactaattctgagctatggcatttcaatcctaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagct

SEQ ID NO: 176229 - DNA, 886 bp, Homo sapiens
  Payload ID: 14600
  Gene Symbol: RNASE11
  Gene Name: ribonuclease, RNase A family, 11 (non-active)
  Uniprot ID: Q8TAA1
  ENST ID: ENST00000555841
  CDS Start-End: 108-707
cagtgacctagagcaggcatggaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactga

SEQ ID NO: 176230 - DNA, 681 bp, Homo sapiens
  Payload ID: 14600
  Gene Symbol: RNASE11
  Gene Name: ribonuclease, RNase A family, 11 (non-active)
  ENST ID: ENST00000557503
  CDS Start-End: 146-681
ggcatttcaatcctgtatgtgagagctagagactcatacagtgacctagagcaggcatggaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaa

SEQ ID NO: 176231 - DNA, 703 bp, Homo sapiens
  Payload ID: 14600
  Gene Symbol: RNASE11
  Gene Name: ribonuclease, RNase A family, 11 (non-active)
  ENST ID: ENST00000557105
  CDS Start-End: 189-703
cacaggctttggagagcactctctgtcctgatcttttcagttgagagacttcagctgttcattgctcatttggacttagttcaaggtcatgtcaaagaagaagaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaatacca

SEQ ID NO: 176232 - DNA, 883 bp, Homo sapiens
  Payload ID: 14600
  Gene Symbol: RNASE11
  Gene Name: ribonuclease, RNase A family, 11 (non-active)
  Uniprot ID: Q8TAA1
  ENST ID: ENST00000620912
  CDS Start-End: 106-705
gtgacctagagcaggcatggaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactg

SEQ ID NO: 176233 - DNA, 631 bp, Homo sapiens
  Payload ID: 14601
  Gene Symbol: RNASE12
  Gene Name: ribonuclease, RNase A family, 12 (non-active)
  Uniprot ID: Q5GAN4
  ENST ID: ENST00000556526
  CDS Start-End: 101-544
ggggttggagcaggaggaatctgactgtcctttgctactttctatcttcccttactcaacagcagtcaaagccaaagatgcgaagtcactcttacctctgatgataataatggtgataattttcttggtgcttctgttctgggaaaatgaggtgaatgatgaagcagtgatgtcaactttagaacacttgcatgtggactaccctcagaatgacgttcccgttcctgcaaggtactgcaaccacatgatcatacaaagagttatcagggaacctgaccacacttgtaaaaaggagcatgtcttcatccatgagaggcctcgaaaaatcaatggtatttgcatttctcccaagaaggttgcttgccaaaacctttcggccattttctgctttcagagtgagacaaagttcaaaatgacagtctgtcagctcattgaaggcacaagataccctgcctgcaggtaccactattcccccacagaggggtttgttcttgtcacttgtgatgacttgaggccagatagtttccttggctatgttaaataactcaagatcagctcccgagtctgagatctcttctctcaatggcattggagctggctgtgcctgaggcagacctggaccgtggacatg

SEQ ID NO: 176234 - DNA, 1607 bp, Homo sapiens
  Payload ID: 14602
  Gene Symbol: RNASE13
  Gene Name: ribonuclease, RNase A family, 13 (non-active)
  Uniprot ID: Q5GAN3
  ENST ID: ENST00000382951
  CDS Start-End: 139-609
atttttacctagaaacctttctagcctctcctcatctcttgactgtcttggccttggcaagaagaatacacgtccctacccagctatcttcagctcctgtccttcctcccagctgccagagaattgtcagcaggaggaatggcaccagctgtgacccggctccttttcctccagcttgttctggggccaactctggtcatggacatcaagatgcagattggcagcaggaacttctataccttaagcattgactatcccagggttaactacccaaagggtttccggggctattgtaatggtctgatgtcctatatgcgaggcaagatgcaaaattcagattgcccaaagatccattatgtgatacatgccccttggaaggccatccagaagttctgcaagtatagtgacagcttctgtgagaattacaatgaatactgcacactcacccaggattccctccccatcacggtctgctccctgagccaccaacagccacccactagctgctactacaatagcaccctaaccaaccagaagctctacctactctgctcccgcaagtatgaagctgatccaataggtatcgctggtctctattcgggaatttaattcctgagccactccccaacctctaccaccacaggccagctgtctccatttccaacactctgatccctgtaacaagacttccttcctgacttacgaggcaggcagggtcccctcccaagagaccaggtgggtgcgaaaatgtccagggctttgatcaccatgcaaagtggtgctatcttctaggttctttccagcttgtttaccccctcttcgcccccacctcctcatcatccttcctctcccagagacagtaaaacccacccaagaagttgactgtgtccagttggcagtgactgtccacccactgggccagatcctaagtcctggatggaggcccagggcctcagctcacaccatggcaacaggcaccagctccgagtctcacctccccatccccaccagccttctcatgtcagcctcccccagttcccttataattccctccactcacccacctactcaggggatatggctagctataggaacctccctgaggccctcagactcatgttagcctcacttccccacaacccccagtttccagcctgcttctctctgtgaaatcatggtttctcccttcatataactgtcctctcctgcttcctcttaccatggagcctaggactgtctcccccacactcccaacaaccgtagtcaccctgccttcctttttccaacctctttttcttccagtcttcttaccttggctcactggcatttcaaggtatcttctctcacccattccccagaggttcctgcttcccttctcttccagaagctcctcccaaatcccccagactccagagtctgcccctgaccaggcagcgaatgaggcaggcccggctctaatcgaacataaatttctaaaaccacatctgagtatgtaagatgtaaccattgggggaaactgggtgaagggcacacgagccccctctgtaccattttttgtaacttcctgtcaacccataatcaattcaaaataaaaagttaataacaca

SEQ ID NO: 176235 - DNA, 755 bp, Homo sapiens
  Payload ID: 14603
  Gene Symbol: RNASE2
  Gene Name: ribonuclease, RNase A family, 2 (liver, eosinophil-derived neurotoxin)
  Uniprot ID: P10153
  ENST ID: ENST00000304625
  CDS Start-End: 91-576
ttccaagtaggggagaccagctgcccctgaaccccagaacaaccagctggatcagttctcacaggagctacagcgcggagactgggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattca

SEQ ID NO: 176236 - DNA, 720 bp, Homo sapiens
  Payload ID: 14604
  Gene Symbol: RNASE3
  Gene Name: ribonuclease, RNase A family, 3
  Uniprot ID: P12724
  ENST ID: ENST00000304639
  CDS Start-End: 59-541
cccagaacaaccagctggatcagttctcacaggagccacagctcagagactgggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcacgtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattca

SEQ ID NO: 176237 - DNA, 853 bp, Homo sapiens
  Payload ID: 14605
  Gene Symbol: RNASE4
  Gene Name: ribonuclease, RNase A family, 4
  Uniprot ID: P34096
  ENST ID: ENST00000397995
  CDS Start-End: 132-575
gtacacacactcacacaaggacgccaaccccacctagatgcaaagcaggattcaaaagaacatctttgcgttttctaccggctccccatcatcgtactagggaggaagaagcgggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatg

SEQ ID NO: 176238 - DNA, 1341 bp, Homo sapiens
  Payload ID: 14605
  Gene Symbol: RNASE4
  Gene Name: ribonuclease, RNase A family, 4
  Uniprot ID: P34096
  ENST ID: ENST00000555597
  CDS Start-End: 111-554
acacaactggaacccatctccaggaacaaacagctggaacccatctcccgttgaagggaaactgccagatttttgtaagattcttcctcctgggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacctgagaa

SEQ ID NO: 176239 - DNA, 2520 bp, Homo sapiens
  Payload ID: 14605
  Gene Symbol: RNASE4
  Gene Name: ribonuclease, RNase A family, 4
  Uniprot ID: P34096
  ENST ID: ENST00000555835
  CDS Start-End: 677-1120
tttttccacccccttttgtcaactactgaaaaaaagtctccgttaaatttgaaacacaaactgtctcgcgatgggctgtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacctgagaagactgtgctatggtattattttttttctctgacttttaaattcttgtttagtttataaacatgcatgcaccttaataacctcataaactctggtcaaagactaatgcctatcagatccatgaccacaacacagaagatttgtctcatttactccagagagaatgattcctctcaaagacaattctcacagctcttccttctcccttagaatatttagaagcaaattagggagctgtcaggtctctgagcccaagcctgcacgtatacatccagatggcctgaagcaactgaagaaccacaaaagaagtgaaaataaccaattcctgccttaactgatgacattccaccactgtgatttgttcctgccccaccttaactgatcaattagccttgtgacattccttctcctggacaattagactcaggagctccccaccagagcaccttgtgacccccgcccctgcccgctagagaataacccactttgaccgtaatttcccactaccaacccaaatcctataaaactgccccaccccatctccctttgctgactccttttttggactcagtctgcctgcacccaggtgattaaaaagctttattgctcacacaa

SEQ ID NO: 176240 - DNA, 1498 bp, Homo sapiens
  Payload ID: 14606
  Gene Symbol: RNASE7
  Gene Name: ribonuclease, RNase A family, 7
  Uniprot ID: Q9H1E1
  ENST ID: ENST00000298690
  CDS Start-End: 258-728
gtatttgggacatgtaagtggagaggcatgaacctgattcatttcctgatccagtgatgctcccagcccacccccaaacagacacagcgtagcccgggccagctcttaaggagttcaggagtgagaagaggccctcagagatctgacagcctaggagtgcgtggacaccacctcagcccactgagcaggagtcacagcacgaagaccaagcgcaaagcgacccctgccctccatcctgactgctcctcctaagagagatggcaccggccagagcaggattctgcccccttctgctgcttctgctgctggggctgtgggtggcagagatcccagtcagtgccaagcccaagggcatgacctcatcacagtggtttaaaattcagcacatgcagcccagccctcaagcatgcaactcagccatgaaaaacattaacaagcacacaaaacggtgcaaagacctcaacaccttcctgcacgagcctttctccagtgtggccgccacctgccagacccccaaaatagcctgcaagaatggcgataaaaactgccaccagagccacggggccgtgtccctgaccatgtgtaagctcacctcagggaagcatccgaactgcaggtacaaagagaagcgacagaacaagtcttacgtagtggcctgtaagcctccccagaaaaaggactctcagcaattccacctggttcctgtacacttggacagagtcctttaggtttccagactggcttgctctttggctgaccttcaattccctctccaggactccgcaccactcccctacacccagagcattctcttcccctcatctcttggggctgttcctggttcagcctctgctgggaggctgaagctgacactctggtgagctgagctctagagggatggcttttcatctttttgttgctgttttcccagatgcttatccccaagaaacagcaagctcaggtctgtgggttccctggtctatgccattgcacatgtctcccctgccccctggcattagggcagcatgacaaggagaggaaataaatggaaagggggcatatgggatttgtggacacagctgtttctgttcctgaactagaagtcttccccagctctgacgtggcagtgaggtgacctgaaggaaagaaaaatataaataaataccacttcatatttgtatagaatcctctaatcccttgtgacatagacttgacagggattgtatgccttctttatggatgaggaaattaaggttttagaaagcttaatgaattaaagagcttgtctaattagttagtagcagaacctggacttgaacctaggtctccttgctctaaatacagtgtaccttctactctaccagttgcgcaagaaagaagtcactgttacagaggcaagcggtgaactaggtaagagttcactcatgaagaaacgagtgctctgaagagccagttaccctgtgttggctgcaataaaggtcattacctctctagccaa

SEQ ID NO: 176241 - DNA, 922 bp, Homo sapiens
  Payload ID: 14606
  Gene Symbol: RNASE7
  Gene Name: ribonuclease, RNase A family, 7
  Uniprot ID: Q9H1E1
  ENST ID: ENST00000481538
  CDS Start-End: 168-638
agcccgggccagctcttaaggagttcaggagtgagaagaggccctcagagatctgacagcctaggagtgcgtggacaccacctcagcccactgagcaggagtcacagcacgaagaccaagcgcaaagcgacccctgccctccatcctgactgctcctcctaagagagatggcaccggccagagcaggattctgcccccttctgctgcttctgctgctggggctgtgggtggcagagatcccagtcagtgccaagcccaagggcatgacctcatcacagtggtttaaaattcagcacatgcagcccagccctcaagcatgcaactcagccatgaaaaacattaacaagcacacaaaacggtgcaaagacctcaacaccttcctgcacgagcctttctccagtgtggccgccacctgccagacccccaaaatagcctgcaagaatggcgataaaaactgccaccagagccacggggccgtgtccctgaccatgtgtaagctcacctcagggaagcatccgaactgcaggtacaaagagaagcgacagaacaagtcttacgtagtggcctgtaagcctccccagaaaaaggactctcagcaattccacctggttcctgtacacttggacagagtcctttaggtttccagactggcttgctctttggctgaccttcaattccctctccaggactccgcaccactcccctacacccagagcattctcttcccctcatctcttggggctgttcctggttcagcctctgctgggaggctgaagctgacactctgttgcgcaagaaagaagtcactgttacagaggcaagcggtgaactaggtaagagttcactcatgaagaaacgagtgctctgaagagccagttaccctgtgttggctgcaataaaggtcattacctctctagccaag

SEQ ID NO: 176242 - DNA, 634 bp, Homo sapiens
  Payload ID: 14607
  Gene Symbol: RNASE8
  Gene Name: ribonuclease, RNase A family, 8
  Uniprot ID: Q8TDE3
  ENST ID: ENST00000308227
  CDS Start-End: 72-536
caagactcccccatgatgacctattcatccacctacctcctcactctgttccactgtctcccttaagagagatggcaccggccagagcaggatgctgccccctgctgctgctgcttctggggctgtgggtggcagaggtcctagtcagagccaagcccaaggacatgacatcatctcagtggtttaaaactcagcatgtgcagcccagccctcaagcatgcaactcagccatgagcatcatcaataagtacacagaacggtgcaaagacctcaacaccttcctgcacgagcccttctccagtgtggccatcacctgccagacccccaacatagcctgcaagaatagctgtaaaaactgccaccagagccacgggcccatgtccctgaccatgggtgagctcacctcagggaagtacccaaactgcaggtacaaagagaagcacctgaacacaccttacatagtggcctgtgaccctccacaacagggtgacccagggtacccacttgttcctgtgcacttggataaagttgtctaagccctggtgcccacgttccacctcacactctgcagactgtatgctgctgcttttcctccctccagttcgttattaatccttgctccccactgcaaatg

SEQ ID NO: 176243 - DNA, 1049 bp, Homo sapiens
  Payload ID: 14608
  Gene Symbol: RNASE9
  Gene Name: ribonuclease, RNase A family, 9 (non-active)
  Uniprot ID: P60153
  ENST ID: ENST00000338904
  CDS Start-End: 73-690
gctctacctcttggacttccaacttctgtgagtcaacatagtgcctcttgcatttaagtgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 176244 - DNA, 1247 bp, Homo sapiens
  Payload ID: 14608
  Gene Symbol: RNASE9
  Gene Name: ribonuclease, RNase A family, 9 (non-active)
  Uniprot ID: P60153
  ENST ID: ENST00000404716
  CDS Start-End: 256-888
gctctacctcttggacttccaacttctgtgagtcaacatagtgcctcttgcatttaagaaacatctcatcacactcttatcagcattgagtttaaatttcaattagtgagaactgaggaaaaaccaagaagcctgcattccacagatcaagatgttgcagaggctccgcgttcttgtgagagtatgttccgagctctctgacctgtcaccatgggatcactcttttgaagagacttcctggaggacactgatgacatgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 176245 - DNA, 1084 bp, Homo sapiens
  Payload ID: 14608
  Gene Symbol: RNASE9
  Gene Name: ribonuclease, RNase A family, 9 (non-active)
  Uniprot ID: P60153
  ENST ID: ENST00000429244
  CDS Start-End: 108-725
gctctacctcttggacttccaacttctgtgagtcaacatagtgcctcttgcatttaagaaacatctcatcacactcttatcagcattgagttttgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 176246 - DNA, 1172 bp, Homo sapiens
  Payload ID: 14608
  Gene Symbol: RNASE9
  Gene Name: ribonuclease, RNase A family, 9 (non-active)
  Uniprot ID: P60153
  ENST ID: ENST00000553706
  CDS Start-End: 181-813
gctctacctcttggacttccaacttctgtgagtcaacatagtgcctcttgcatttaagaaacatctcatcacactcttatcagcattgagtttaaatttcaattagtgagaactgaggaaaaaccaagaagcctgcattccacagatcaagatgttgcagaggctccgcgttcttgtgagatgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 176247 - DNA, 1101 bp, Homo sapiens
  Payload ID: 14608
  Gene Symbol: RNASE9
  Gene Name: ribonuclease, RNase A family, 9 (non-active)
  Uniprot ID: P60153
  ENST ID: ENST00000554964
  CDS Start-End: 125-742
gctctacctcttggacttccaacttctgtgagtcaacatagtgcctcttgcatttaagaaatttcaattagtgagaactgaggaaaaaccaagaagcctgcattccacagtgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 176248 - DNA, 2668 bp, Homo sapiens
  Payload ID: 14608
  Gene Symbol: RNASE9
  Gene Name: ribonuclease, RNase A family, 9 (non-active)
  Uniprot ID: P60153
  ENST ID: ENST00000555230
  CDS Start-End: 1692-2309
gctctacctcttggacttccaacttctgtgagtcaacatagtgcctcttgcatttaagaaatttcaattagtgagaactgaggaaaaaccaagaagcctgcattccacagatcaagatgttgcagaggctccgcgttcttgtgagagtatgttccgagctctctgacctgtcaccatgggatcactcttttgaagagacttcctggaggacactgatgacagtgtgaaagcagggatgggaggaaaagcagggaggggagggacagtgtggcacatggccgccccagagtgcccattctcacatcgccattttaggcaactttttcttttctttcccattctctgcactcctatgctcaactttcctgtctctactttctgatgtgttccccaacacccacctttctttaattccatcattctctaacctttctacacacatatatacaaacttagtatccagcctagaacaggaggctgtccatctccatcactgatagatcaaggtctccaggtaatgactgttagagaatcactcaggttgccaccaagtaggacttcttttacaacgagcctggtaaggtaagaaaactcaggaggttgcttctgcaattaaataattggttcttcatggagcatggaccaatttgtcaaagcactctaggggctcaaattccgttttagcactggccatttcagtagtcattgtgtttgacagcctagagagagagatacagtctagccttaagaagggaaaccagactgatagaggccatagaatagcagctaaggacagatgtgtggaatttagacaaaaataggcttgaaccaggagtctgccggatctaatgtgagattttaagcaacttcccttcacggagagatgttaataactttacacttctttttgcaactttcattgttataataacaacaatgctaaaaataatatatttattatagggttgtttggatgatggtgataatgtacttagagtgcttagtctagtgcttggcacttaactcctcattatgctagctatgactgtgtatcattgtttttactttagggtgacttcaagaatgtatttatcccagctgctcaaacttgaaccttccttgaccccttccccaagggcatctatggtcaaataagggcaagaggagaaagaaagacatggttaaggaatttttcttatcaaagtggaatgttcgaaaggggagggtggctcttttcagagcaagttctcaactcctggaaagggaaaagatgcatttatttcagacgaaaggagcatgtgagcctcctctctgcaccctccctttctccccactgctgtcttgatttcctttctccttccctctctccttaatctctctcttgctccatttcttccttgtttccttttcttcctccttacctttatttctctccctttctcattctccttcctttcaccttttcttctcttaccacagctctagactgactgtaggcctagtaaggtcatttttgtcaataatttagaagtattcagatcgattatgagttggtaatttaaaaatggtccaaaatcttagagcccagaacagcaacatgtggcataactgtgccccacacaggaaatggaagcaagcacattatcacaatagaacatatcccgttatctcttttagtgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 176249 - DNA, 1137 bp, Homo sapiens
  Payload ID: 14608
  Gene Symbol: RNASE9
  Gene Name: ribonuclease, RNase A family, 9 (non-active)
  Uniprot ID: P60153
  ENST ID: ENST00000557209
  CDS Start-End: 146-778
gctctacctcttggacttccaacttctgtgagtcaacatagtgcctcttgcatttaagaaatttcaattagtgagaactgaggaaaaaccaagaagcctgcattccacagatcaagatgttgcagaggctccgcgttcttgtgagatgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 176250 - DNA, 1212 bp, Homo sapiens
  Payload ID: 14608
  Gene Symbol: RNASE9
  Gene Name: ribonuclease, RNase A family, 9 (non-active)
  Uniprot ID: P60153
  ENST ID: ENST00000556208
  CDS Start-End: 221-853
gctctacctcttggacttccaacttctgtgagtcaacatagtgcctcttgcatttaagaaatttcaattagtgagaactgaggaaaaaccaagaagcctgcattccacagatcaagatgttgcagaggctccgcgttcttgtgagagtatgttccgagctctctgacctgtcaccatgggatcactcttttgaagagacttcctggaggacactgatgacatgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 176251 - DNA, 1136 bp, Homo sapiens
  Payload ID: 14608
  Gene Symbol: RNASE9
  Gene Name: ribonuclease, RNase A family, 9 (non-active)
  Uniprot ID: P60153
  ENST ID: ENST00000553541
  CDS Start-End: 160-777
gctctacctcttggacttccaacttctgtgagtcaacatagtgcctcttgcatttaagaaacatctcatcacactcttatcagcattgagtttaaatttcaattagtgagaactgaggaaaaaccaagaagcctgcattccacagtgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 176252 - DNA, 2703 bp, Homo sapiens
  Payload ID: 14608
  Gene Symbol: RNASE9
  Gene Name: ribonuclease, RNase A family, 9 (non-active)
  Uniprot ID: P60153
  ENST ID: ENST00000557068
  CDS Start-End: 1727-2344
gctctacctcttggacttccaacttctgtgagtcaacatagtgcctcttgcatttaagaaacatctcatcacactcttatcagcattgagtttaaatttcaattagtgagaactgaggaaaaaccaagaagcctgcattccacagatcaagatgttgcagaggctccgcgttcttgtgagagtatgttccgagctctctgacctgtcaccatgggatcactcttttgaagagacttcctggaggacactgatgacagtgtgaaagcagggatgggaggaaaagcagggaggggagggacagtgtggcacatggccgccccagagtgcccattctcacatcgccattttaggcaactttttcttttctttcccattctctgcactcctatgctcaactttcctgtctctactttctgatgtgttccccaacacccacctttctttaattccatcattctctaacctttctacacacatatatacaaacttagtatccagcctagaacaggaggctgtccatctccatcactgatagatcaaggtctccaggtaatgactgttagagaatcactcaggttgccaccaagtaggacttcttttacaacgagcctggtaaggtaagaaaactcaggaggttgcttctgcaattaaataattggttcttcatggagcatggaccaatttgtcaaagcactctaggggctcaaattccgttttagcactggccatttcagtagtcattgtgtttgacagcctagagagagagatacagtctagccttaagaagggaaaccagactgatagaggccatagaatagcagctaaggacagatgtgtggaatttagacaaaaataggcttgaaccaggagtctgccggatctaatgtgagattttaagcaacttcccttcacggagagatgttaataactttacacttctttttgcaactttcattgttataataacaacaatgctaaaaataatatatttattatagggttgtttggatgatggtgataatgtacttagagtgcttagtctagtgcttggcacttaactcctcattatgctagctatgactgtgtatcattgtttttactttagggtgacttcaagaatgtatttatcccagctgctcaaacttgaaccttccttgaccccttccccaagggcatctatggtcaaataagggcaagaggagaaagaaagacatggttaaggaatttttcttatcaaagtggaatgttcgaaaggggagggtggctcttttcagagcaagttctcaactcctggaaagggaaaagatgcatttatttcagacgaaaggagcatgtgagcctcctctctgcaccctccctttctccccactgctgtcttgatttcctttctccttccctctctccttaatctctctcttgctccatttcttccttgtttccttttcttcctccttacctttatttctctccctttctcattctccttcctttcaccttttcttctcttaccacagctctagactgactgtaggcctagtaaggtcatttttgtcaataatttagaagtattcagatcgattatgagttggtaatttaaaaatggtccaaaatcttagagcccagaacagcaacatgtggcataactgtgccccacacaggaaatggaagcaagcacattatcacaatagaacatatcccgttatctcttttagtgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatcta

SEQ ID NO: 176253 - DNA, 1108 bp, Homo sapiens
  Payload ID: 14608
  Gene Symbol: RNASE9
  Gene Name: ribonuclease, RNase A family, 9 (non-active)
  Uniprot ID: P60153
  ENST ID: ENST00000611135
  CDS Start-End: 118-750
tctccagatcaagatgttgcagaggctccgcgttcttgtgagagtatgttccgagctctctgacctgtcaccatgggatcactcttttgaagagacttcctggaggacactgatgacatgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcagtgaggatggtgtctttgtcatatcgccctagcagagcgttctctgagagcttagggtgggaggaatatttctctccatactgatccttatagatcaaagttgagaatggtaattttgcttccattcactttaatcacccaccttcctttcttcctttcccaacacctcacaaaagcaccttaggctaggttcacagacggtgctctgagatgtggtctcatgcaggtcccctaagttagcatgccttgaatgtgttacggatacagatgcctgcagtggaaggatgaccagcaccaagaggaaaaggaaatggttgcctgaagtgtgctccaaagacacatccatgtgattctctagttcagcagaaagaataaaaattgcttcaatct

SEQ ID NO: 176254 - DNA, 1061 bp, Homo sapiens
  Payload ID: 14609
  Gene Symbol: RNASE6
  Gene Name: ribonuclease, RNase A family, k6
  Uniprot ID: Q93091
  ENST ID: ENST00000304677
  CDS Start-End: 294-746
gttttcagtcatgttgtttctttaagttggtttagccttcctgtatacatgtgataatgatactgttttaaagaacaggtgtgaaagtctaagagtttaatccagactctgcacaagaagttaatctgccaaaccctaggattctccttctgaaagctcagaatatttcttccccttccctatacacacagggctcgaagggttagagaagaaaggcagacaacagcttctgagctttggactaatcacagcctctgttctcagcaggagccccaacactgagaccagaaaagatggtgctatgctttcctcttcttttactgctgctggttctatggggaccagtgtgtccacttcatgcttggcctaagcgtctcaccaaggctcactggtttgaaattcagcatatacagccaagtcctctccaatgcaacagggcaatgagtggcatcaacaattatacccagcactgtaagcatcaaaatacctttctgcatgactctttccagaatgtggctgctgtctgtgatttgctcagcattgtctgcaaaaatcgtcggcacaactgccaccagagctcaaagcctgtcaacatgactgactgcagactcacttcaggaaagtatccccagtgccgctatagtgctgctgcccagtacaaattcttcattgttgcctgtgacccccctcagaagagcgatcccccctacaagttggttcctgtacacttagatagtattctctaaggcatccactgcatttcctttcatttgacatagcttctgttacaattgcatccatgttttcttttcttttgttgattttcttgttcccgtagaagaaagaagaaaggtgtttggagaattcgagtgcctaggatgccagaccagagttgagacaaaaagaaataagattattttctgctttgtagttctgtacttttcgagagaagggaatagggaagacagcaaagaaagattcagatttctaaccctgcaacttttgccaagctttattgccctgtgttcacagcaataaaaccacttcctgctgcattctaa

SEQ ID NO: 176255 - DNA, 952 bp, Homo sapiens
  Payload ID: 14610
  Gene Symbol: RNASEK
  Gene Name: ribonuclease, RNase K
  ENST ID: ENST00000546395
  CDS Start-End: 107-304
acagaggtcaaggaaggtttccccaggagcagttttggtttcagacggcgccgtctcccgcgaaagtcctgagaggagcccagccttttccgcctgccgcccccggatgggatggttgaggccggggccacgccccctctgcccccctgcgagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccagataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaat

SEQ ID NO: 176256 - DNA, 591 bp, Homo sapiens
  Payload ID: 14610
  Gene Symbol: RNASEK
  Gene Name: ribonuclease, RNase K
  ENST ID: ENST00000552039
  CDS Start-End: 130-345
ccaccgctttccgagcccgcttgcacctcggcgatccccgactcccttctttatggcgtcgctcctgtgctgtgggccgaagctggccgcctgcggcatcgtcctcagcgcctggggagtgatcatataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaatctgctctcttca

SEQ ID NO: 176257 - DNA, 810 bp, Homo sapiens
  Payload ID: 14610
  Gene Symbol: RNASEK
  Gene Name: ribonuclease, RNase K
  Uniprot ID: Q6P5S7
  ENST ID: ENST00000548577
  CDS Start-End: 151-564
aacaaaccggaggccctcgctcttccaatactcacgccctagctacagaggtcaaggaaggtttccccaggagcagttttggtttcagacggcgccgtctcccgcgaaagtcctgagaggagcccagccttttccgcctgccgcccccggatgggatggttgaggccggggccacgccccctctgcccccctgcgagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaatctgctctcttca

SEQ ID NO: 176258 - DNA, 595 bp, Homo sapiens
  Payload ID: 14610
  Gene Symbol: RNASEK
  Gene Name: ribonuclease, RNase K
  ENST ID: ENST00000552842
  CDS Start-End: 39-179
gcccgcttgcacctcggcgatccccgactcccttctttatggcgtcgctcctgtgctgtgggccgaagctggccgcctgcggcatcgtcctcagcgcctggggagtgatcatgttggtgaggggactccccgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaatctgctctctt

SEQ ID NO: 176259 - DNA, 783 bp, Homo sapiens
  Payload ID: 14610
  Gene Symbol: RNASEK
  Gene Name: ribonuclease, RNase K
  ENST ID: ENST00000549393
  CDS Start-End: 149-550
ccgcttgcacctcggcgatccccgactcccttctttatggcgtcgctcctgtgctgtgggccgaagctggccgcctgcggcatcgtcctcagcgcctggggagtgatcatgttgtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccaggtggctgagtccgaatccaataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaa

SEQ ID NO: 176260 - DNA, 739 bp, Homo sapiens
  Payload ID: 14610
  Gene Symbol: RNASEK
  Gene Name: ribonuclease, RNase K
  ENST ID: ENST00000552321
  CDS Start-End: 123-290
cctgagaggtgcttgagttgaatggaggacatgggaggaaaagagagtgcttgttccagaaatgtgtagctgggccttgttttcccagtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccagataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaat

SEQ ID NO: 176261 - DNA, 425 bp, Homo sapiens
  Payload ID: 14610
  Gene Symbol: RNASEK
  Gene Name: ribonuclease, RNase K
  ENST ID: ENST00000570898
  CDS Start-End: 166-381
gggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgtctacccattccccttttccagataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaag

SEQ ID NO: 176262 - DNA, 566 bp, Homo sapiens
  Payload ID: 14610
  Gene Symbol: RNASEK
  Gene Name: ribonuclease, RNase K
  ENST ID: ENST00000593646
  CDS Start-End: 74-370
gagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttct

SEQ ID NO: 176263 - DNA, 1894 bp, Homo sapiens
  Payload ID: 14611
  Gene Symbol: RNH1
  Gene Name: ribonuclease/angiogenin inhibitor 1
  Uniprot ID: P13489
  ENST ID: ENST00000354420
  CDS Start-End: 370-1755
tggcgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatatt

SEQ ID NO: 176264 - DNA, 1791 bp, Homo sapiens
  Payload ID: 14611
  Gene Symbol: RNH1
  Gene Name: ribonuclease/angiogenin inhibitor 1
  Uniprot ID: P13489
  ENST ID: ENST00000356187
  CDS Start-End: 276-1661
gccgagccccgcccagtagtccccgcccacgcacctgaccacgcccacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgc

SEQ ID NO: 176265 - DNA, 1722 bp, Homo sapiens
  Payload ID: 14611
  Gene Symbol: RNH1
  Gene Name: ribonuclease/angiogenin inhibitor 1
  Uniprot ID: P13489
  ENST ID: ENST00000397604
  CDS Start-End: 161-1546
cgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggca

SEQ ID NO: 176266 - DNA, 1864 bp, Homo sapiens
  Payload ID: 14611
  Gene Symbol: RNH1
  Gene Name: ribonuclease/angiogenin inhibitor 1
  Uniprot ID: P13489
  ENST ID: ENST00000397614
  CDS Start-End: 301-1686
ggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagg

SEQ ID NO: 176267 - DNA, 2014 bp, Homo sapiens
  Payload ID: 14611
  Gene Symbol: RNH1
  Gene Name: ribonuclease/angiogenin inhibitor 1
  Uniprot ID: P13489
  ENST ID: ENST00000397615
  CDS Start-End: 453-1838
cctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggca

SEQ ID NO: 176268 - DNA, 1725 bp, Homo sapiens
  Payload ID: 14611
  Gene Symbol: RNH1
  Gene Name: ribonuclease/angiogenin inhibitor 1
  Uniprot ID: P13489
  ENST ID: ENST00000438658
  CDS Start-End: 197-1582
aagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttgg

SEQ ID NO: 176269 - DNA, 624 bp, Homo sapiens
  Payload ID: 14611
  Gene Symbol: RNH1
  Gene Name: ribonuclease/angiogenin inhibitor 1
  ENST ID: ENST00000524464
  CDS Start-End: 135-368
gctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcgggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgcc

SEQ ID NO: 176270 - DNA, 1019 bp, Homo sapiens
  Payload ID: 14611
  Gene Symbol: RNH1
  Gene Name: ribonuclease/angiogenin inhibitor 1
  ENST ID: ENST00000529768
  CDS Start-End: 1-858
gagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtgtatgtgcacgcgctgggcgggtggtgcggccagggctgcccagggaggaaggcgggggtgggggaggacacgggcccatgcctcccttctggcctgtgtgcagcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacac

SEQ ID NO: 176271 - DNA, 480 bp, Homo sapiens
  Payload ID: 14611
  Gene Symbol: RNH1
  Gene Name: ribonuclease/angiogenin inhibitor 1
  ENST ID: ENST00000531540
  CDS Start-End: 455-480
agaggacttctgcaccgtttcccgaggacagtttggcagtgtttcagaagggccttagaaccaggcaggcccccttctaggatggtggaaagcctaaagatctgaaaacggtctcaagtgtcgtcttagcgattggctgactaaaccgaatgcaagccggagactgcacacgatgttgccgttaacagttacactgggccgggcagtcagaggcaggcggatcacctgaggtcaggagttcgagaacagcctggccaacatggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggccactcttcacctccaccatgagcctggacatccagagcctgga

SEQ ID NO: 176272 - DNA, 855 bp, Homo sapiens
  Payload ID: 14611
  Gene Symbol: RNH1
  Gene Name: ribonuclease/angiogenin inhibitor 1
  ENST ID: ENST00000529115
  CDS Start-End: 172-678
gaccacgcccacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccacc

SEQ ID NO: 176273 - DNA, 2973 bp, Homo sapiens
  Payload ID: 14611
  Gene Symbol: RNH1
  Gene Name: ribonuclease/angiogenin inhibitor 1
  Uniprot ID: P13489
  ENST ID: ENST00000534797
  CDS Start-End: 1409-2794
cacaccctggtcggttttgctcacgtgcttcgggtcggttggattcagttcctccatgtggggccgtgggatgtcaccaccctttgccactgtccttgcaggccgggcgcccaggcgtgtggacccgagcccagccttgcgtctttcctcccagttggtaccaggggcctcttgcctccactcatgcagagtggaccagccgcctctgaagcagccccggggagaggagtgccaggcacacagactcaggaagctgggggtgtcagggcaccaggagcctctcaagcggtcctgttggccgtctttctgaagggcagctggggttgcatcatttccccaagtggatcctgccaactttctggggcttctggatgagagccctctccccaccccacccacccctccccgcattgtggcatcagtgctgctgcttccagggagccttcctggccatccaagcctcctctccaggttcctgccctgctgtagtccccaggccagtgcttggcaggtgctcagggaatgtatccaccaaccaaggtttggggtggctgtctctgcctgaccactttccccaggcccctggcgggtacctgagctgtgctctcagggcctcaggaacctccttccatattcagggcctgtgcctggggaggcttcagggtgtagcagctgtgcccatcccaggctgacccacccagcttgcctggtagcccagcctctgggctagtgtgccgtggggcaggggatgtgctgtagcctggtgcagagtccccaaccccagaagggggccatggaagctgacaccccaagtggccgcccccctgctctgtcttgcttcggacactgtggccgggtccaggatcctggcatcctgggaggtctctggctttgtgggcagcctgcctggcccgcacagtctgcctgtcctgagggtgagacacaggtcaagcccacagacccccttgctcccctgctggggcctccaggctcacagaccaccccaccctaccctgtccttgcccaagcaaatgagaggcaggggcttcccgggctgctgctgtcccgccctctgtggggcaggaggaggtgcccacagaggctgggtggtgatagccaggagatgggctggcatctgcattacccaagctctgctgcccatggtggcctttctgggggtgggtgctggtccctgccccctgccccacccctgatgtctgctccagagacaaaggtggggagggtgctgaagaggaagtgtttgcccagggagaggctgcggctcctcctgaaacatcagccctgtgggtcctgtttgcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 176274 - DNA, 870 bp, Homo sapiens
  Payload ID: 14611
  Gene Symbol: RNH1
  Gene Name: ribonuclease/angiogenin inhibitor 1
  ENST ID: ENST00000529306
  CDS Start-End: 304-870
cgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtg

SEQ ID NO: 176275 - DNA, 704 bp, Homo sapiens
  Payload ID: 14611
  Gene Symbol: RNH1
  Gene Name: ribonuclease/angiogenin inhibitor 1
  ENST ID: ENST00000532055
  CDS Start-End: 584-704
gaggacagtttggcagtgtttcagaagggccttagaaccaggcaggcccccttctaggatggtggaaagcctaaagatctgaaaacggtctcaagtgtcgtcttagcgattggctgactaaaccgaatgcaagccggagactgcacacgatgttgccgttaacagttacactgggccgggcagtcagaggcaggcggatcacctgaggtcaggagttcgagaacagcctggccaacatgaggccaccttcttccatcttcaaaacctactgtctctgcataagaactctcatgattatatgccggccgcccagacaccccagggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctca

SEQ ID NO: 176276 - DNA, 727 bp, Homo sapiens
  Payload ID: 14611
  Gene Symbol: RNH1
  Gene Name: ribonuclease/angiogenin inhibitor 1
  ENST ID: ENST00000529368
  CDS Start-End: 146-727
cgactagcgggcgcggcccccagggtggactccccgccagccccggcctggaggctccgcccgcccccgcctgggcggaaggaacgcggagcggctctggccttgggtctgcggcggcggcgtcgggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctg

SEQ ID NO: 176277 - DNA, 1829 bp, Homo sapiens
  Payload ID: 14611
  Gene Symbol: RNH1
  Gene Name: ribonuclease/angiogenin inhibitor 1
  Uniprot ID: P13489
  ENST ID: ENST00000533410
  CDS Start-End: 299-1684
cgggtggggttgtcgacacgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggac

SEQ ID NO: 176278 - DNA, 873 bp, Homo sapiens
  Payload ID: 14611
  Gene Symbol: RNH1
  Gene Name: ribonuclease/angiogenin inhibitor 1
  ENST ID: ENST00000527485
  CDS Start-End: 276-873
acgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgcc

SEQ ID NO: 176279 - DNA, 709 bp, Homo sapiens
  Payload ID: 14611
  Gene Symbol: RNH1
  Gene Name: ribonuclease/angiogenin inhibitor 1
  ENST ID: ENST00000531149
  CDS Start-End: 167-709
cgcccacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccaccatgagcctggacatccagagcctggacatccagtgtgaggagctgagcgacgctagatgggccgagctcctccctctgctccagcagtgccaagtggtcaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcattgtcctttgcaaggcacagctgccccaggacccgacggtgggaacagatgcctggccgtgagtcaggttccactcaccgcctcagtgtgtgtgggggac

SEQ ID NO: 176280 - DNA, 1794 bp, Homo sapiens
  Payload ID: 14611
  Gene Symbol: RNH1
  Gene Name: ribonuclease/angiogenin inhibitor 1
  ENST ID: ENST00000525701
  CDS Start-End: 233-340
cccacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggttgtaacctgcacgtggggtggtggtggaggctgaggccagtgctgtctgcgtggtccacatgaccctggggtctgctcacaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgaggagctgcacctcagcgacaacctcttgggggatgcgggcctgcagctgctctgcgaaggactcctggacccccagtgccgcctggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtgggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactt

SEQ ID NO: 176281 - DNA, 1864 bp, Homo sapiens; identical to SEQ ID NO: 176266
  Payload ID: 14611
  Gene Symbol: RNH1
  Gene Name: ribonuclease/angiogenin inhibitor 1
  Uniprot ID: P13489
  ENST ID: ENST00000618184
  CDS Start-End: 301-1686

SEQ ID NO: 176282 - DNA, 1894 bp, Homo sapiens; identical to SEQ ID NO: 176263
  Payload ID: 14611
  Gene Symbol: RNH1
  Gene Name: ribonuclease/angiogenin inhibitor 1
  Uniprot ID: P13489
  ENST ID: ENST00000612988
  CDS Start-End: 370-1755

SEQ ID NO: 176283 - DNA, 2014 bp, Homo sapiens; identical to SEQ ID NO: 176267
  Payload ID: 14611
  Gene Symbol: RNH1
  Gene Name: ribonuclease/angiogenin inhibitor 1
  Uniprot ID: P13489
  ENST ID: ENST00000619599
  CDS Start-End: 453-1838

SEQ ID NO: 176284 - DNA, 2973 bp, Homo sapiens; identical to SEQ ID NO: 176273
  Payload ID: 14611
  Gene Symbol: RNH1
  Gene Name: ribonuclease/angiogenin inhibitor 1
  Uniprot ID: P13489
  ENST ID: ENST00000621211
  CDS Start-End: 1409-2794

SEQ ID NO: 176285 - DNA, 1791 bp, Homo sapiens; identical to SEQ ID NO: 176264
  Payload ID: 14611
  Gene Symbol: RNH1
  Gene Name: ribonuclease/angiogenin inhibitor 1
  Uniprot ID: P13489
  ENST ID: ENST00000617351
  CDS Start-End: 276-1661

SEQ ID NO: 176286 - DNA, 870 bp, Homo sapiens; identical to SEQ ID NO: 176274
  Payload ID: 14611
  Gene Symbol: RNH1
  Gene Name: ribonuclease/angiogenin inhibitor 1
  ENST ID: ENST00000633732
  CDS Start-End: 304-870

SEQ ID NO: 176287 - DNA, 1722 bp, Homo sapiens; identical to SEQ ID NO: 176265
  Payload ID: 14611
  Gene Symbol: RNH1
  Gene Name: ribonuclease/angiogenin inhibitor 1
  Uniprot ID: P13489
  ENST ID: ENST00000632954
  CDS Start-End: 161-1546

SEQ ID NO: 176288 - DNA, 1829 bp, Homo sapiens; identical to SEQ ID NO: 176277
  Payload ID: 14611
  Gene Symbol: RNH1
  Gene Name: ribonuclease/angiogenin inhibitor 1
  Uniprot ID: P13489
  ENST ID: ENST00000632527
  CDS Start-End: 299-1684

SEQ ID NO: 176289 - DNA, 727 bp, Homo sapiens; identical to SEQ ID NO: 176276
  Payload ID: 14611
  Gene Symbol: RNH1
  Gene Name: ribonuclease/angiogenin inhibitor 1
  ENST ID: ENST00000631468
  CDS Start-End: 146-727

SEQ ID NO: 176290 - DNA, 624 bp, Homo sapiens; identical to SEQ ID NO: 176269
  Payload ID: 14611
  Gene Symbol: RNH1
  Gene Name: ribonuclease/angiogenin inhibitor 1
  ENST ID: ENST00000634214
  CDS Start-End: 135-368

SEQ ID NO: 176291 - DNA, 480 bp, Homo sapiens; identical to SEQ ID NO: 176271
  Payload ID: 14611
  Gene Symbol: RNH1
  Gene Name: ribonuclease/angiogenin inhibitor 1
  ENST ID: ENST00000631828
  CDS Start-End: 455-480

SEQ ID NO: 176292 - DNA, 704 bp, Homo sapiens; identical to SEQ ID NO: 176275
  Payload ID: 14611
  Gene Symbol: RNH1
  Gene Name: ribonuclease/angiogenin inhibitor 1
  ENST ID: ENST00000633418
  CDS Start-End: 584-704

SEQ ID NO: 176293 - DNA, 1019 bp, Homo sapiens; identical to SEQ ID NO: 176270
  Payload ID: 14611
  Gene Symbol: RNH1
  Gene Name: ribonuclease/angiogenin inhibitor 1
  ENST ID: ENST00000631652
  CDS Start-End: 1-858

SEQ ID NO: 176294 - DNA, 873 bp, Homo sapiens; identical to SEQ ID NO: 176278
  Payload ID: 14611
  Gene Symbol: RNH1
  Gene Name: ribonuclease/angiogenin inhibitor 1
  ENST ID: ENST00000633464
  CDS Start-End: 276-873

SEQ ID NO: 176295 - DNA, 1725 bp, Homo sapiens; identical to SEQ ID NO: 176268
  Payload ID: 14611
  Gene Symbol: RNH1
  Gene Name: ribonuclease/angiogenin inhibitor 1
  Uniprot ID: P13489
  ENST ID: ENST00000633287
  CDS Start-End: 197-1582

SEQ ID NO: 176296 - DNA, 1794 bp, Homo sapiens; identical to SEQ ID NO: 176280
  Payload ID: 14611
  Gene Symbol: RNH1
  Gene Name: ribonuclease/angiogenin inhibitor 1
  ENST ID: ENST00000631544
  CDS Start-End: 233-340

SEQ ID NO: 176297 - DNA, 2362 bp, Homo sapiens
  Payload ID: 14612
  Gene Symbol: RAE1
  Gene Name: ribonucleic acid export 1
  Uniprot ID: P78406
  ENST ID: ENST00000371242
  CDS Start-End: 144-1250
cgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgcttcccgagcttcctttgtccttttctccccttgcccaccccgtaacctcaggaacatgcgtcctgcccagcatcagcgtggggttttgagttgagatttcagacaccctctgggaaatgcggcaaccttaggggaaagggagtccccagctgcgctcacttctgctgcgcggaacggcagcctctgtgagccctggtgggcagagtttgaatgtgtttttccttgcttccctcattcccatcttcaaaatccccagtgctttctggccttgctgctcagatttccgagtgactcaaatggggactgttacttgtgctgggtgacaggccatttgtgggtaacctcctaaggcccaagtgggtgacacttgcgtgactttcaagttagaacccaagccccctgcatgggaattgccctgaactcttacccaccccggtcccctgcatgggaattgccctgaaccctcagtagtggttgtttggctgttcttttgtattttgtgtaatttaaaattcctggttggtaagtattcaaaatgaaattcagctgggctgagaaaaagtgtgacttttgggtctgtcactgtatttctcacctgtgatctcaaatgcttcttaggcctttctgtttggactaatgtgtgaagtctgacttgctgagtgtaaaattctagtatcgatagtgttgtaagatgtgtttgcctactcataaaaaacaatgaaaataaaattttctactggaagagaccacctgca

SEQ ID NO: 176298 - DNA, 2602 bp, Homo sapiens
  Payload ID: 14612
  Gene Symbol: RAE1
  Gene Name: ribonucleic acid export 1
  Uniprot ID: P78406
  ENST ID: ENST00000395840
  CDS Start-End: 384-1490
gcttcgttactgggccctggaagcgaggtcagagctggaaatggccttaggggtcacctagggcctaatccatcgtttctcttgtgggggaactgagcctctgggaagggtcacattgcgttaatgcagtgtgtgtcgcctctgtccctcccccttacacgtctggcgtctcgtcagatacatgtcagctcctgggagaagctttccctggccgctttgcagaagggcgtccccttttagcctcttccacgtcaacctgctccatttctttcgtagcagttaccagtctctgaaactaagtctgtttctgtcttagcccgccaagtatttattgtatacgtatataggtgccaccgtacaggcagtacttctccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgcttcccgagcttcctttgtccttttctccccttgcccaccccgtaacctcaggaacatgcgtcctgcccagcatcagcgtggggttttgagttgagatttcagacaccctctgggaaatgcggcaaccttaggggaaagggagtccccagctgcgctcacttctgctgcgcggaacggcagcctctgtgagccctggtgggcagagtttgaatgtgtttttccttgcttccctcattcccatcttcaaaatccccagtgctttctggccttgctgctcagatttccgagtgactcaaatggggactgttacttgtgctgggtgacaggccatttgtgggtaacctcctaaggcccaagtgggtgacacttgcgtgactttcaagttagaacccaagccccctgcatgggaattgccctgaactcttacccaccccggtcccctgcatgggaattgccctgaaccctcagtagtggttgtttggctgttcttttgtattttgtgtaatttaaaattcctggttggtaagtattcaaaatgaaattcagctgggctgagaaaaagtgtgacttttgggtctgtcactgtatttctcacctgtgatctcaaatgcttcttaggcctttctgtttggactaatgtgtgaagtctgacttgctgagtgtaaaattctagtatcgatagtgttgtaagatgtgtttgcctactcataaaaaacaatgaaaataaaattttctactggaagagaccacctgca

SEQ ID NO: 176299 - DNA, 2639 bp, Homo sapiens
  Payload ID: 14612
  Gene Symbol: RAE1
  Gene Name: ribonucleic acid export 1
  Uniprot ID: P78406
  ENST ID: ENST00000395841
  CDS Start-End: 421-1527
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgcttcccgagcttcctttgtccttttctccccttgcccaccccgtaacctcaggaacatgcgtcctgcccagcatcagcgtggggttttgagttgagatttcagacaccctctgggaaatgcggcaaccttaggggaaagggagtccccagctgcgctcacttctgctgcgcggaacggcagcctctgtgagccctggtgggcagagtttgaatgtgtttttccttgcttccctcattcccatcttcaaaatccccagtgctttctggccttgctgctcagatttccgagtgactcaaatggggactgttacttgtgctgggtgacaggccatttgtgggtaacctcctaaggcccaagtgggtgacacttgcgtgactttcaagttagaacccaagccccctgcatgggaattgccctgaactcttacccaccccggtcccctgcatgggaattgccctgaaccctcagtagtggttgtttggctgttcttttgtattttgtgtaatttaaaattcctggttggtaagtattcaaaatgaaattcagctgggctgagaaaaagtgtgacttttgggtctgtcactgtatttctcacctgtgatctcaaatgcttcttaggcctttctgtttggactaatgtgtgaagtctgacttgctgagtgtaaaattctagtatcgatagtgttgtaagatgtgtttgcctactcataaaaaacaatgaaaataaaattttctactggaagagaccacctgca

SEQ ID NO: 176300 - DNA, 588 bp, Homo sapiens
  Payload ID: 14612
  Gene Symbol: RAE1
  Gene Name: ribonucleic acid export 1
  ENST ID: ENST00000411894
  CDS Start-End: 177-588
gggatgctggggcgcgagcgggactgttgactaagcttcgttactgggccctggaagcgaggtgccaccgtacaggcagtacttctccaggcaagtagtattaaacaccagccgccctgggccaggcattgtactgtgggacccagtatgcattaagggaagaatccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaag

SEQ ID NO: 176301 - DNA, 480 bp, Homo sapiens
  Payload ID: 14612
  Gene Symbol: RAE1
  Gene Name: ribonucleic acid export 1
  ENST ID: ENST00000429339
  CDS Start-End: 69-480
gggatgctggggcgcgagcgggactgttgactaagcttcgttactgggccctggaagcgaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaag

SEQ ID NO: 176302 - DNA, 691 bp, Homo sapiens
  Payload ID: 14612
  Gene Symbol: RAE1
  Gene Name: ribonucleic acid export 1
  ENST ID: ENST00000452119
  CDS Start-End: 430-691
gctggaaatggccttaggggtcacctagggcctaatccatcgtttctcttgtgggggaactgagcctctgggaagggtcacattgcgttaatgcagtgtgtgtcgcctctgtccctcccccttacacgtctggcgtctcgtcagatacatgtcagctcctgggagaagctttccctggccgctttgcagaagggcgtccccttttagcctcttccacgtcaacctgctccatttctttcgtagcagttaccagtctctgaaactaagtctgtttctgtcttagcccgccaagtatttattgtatacgtatataggtgccaccgtacaggcagtacttctccaggcaagtagtattaaacaccagccgccctgggccaggcattgtactgtgggacccagtatgcattaagggaagaatccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggc

SEQ ID NO: 176303 - DNA, 1503 bp, Homo sapiens
  Payload ID: 14612
  Gene Symbol: RAE1
  Gene Name: ribonucleic acid export 1
  ENST ID: ENST00000527947
  CDS Start-End: 179-1492
gttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaaggtgagaactcccgggcctgctctgggtgctccaaggcagcagagccaggctctgggttcagaaggcctaggcctgagttgtgactcttctcaggactcacgtgtgtccttgggcaggtcaccgtcccctccctgtaaggggaaattgcaggacttcctcaaatggttgtggggattcagtacagcctttggccagaacccagcacacaggaagtgctcggccagtgtgagccattacgggctgctctgttcctgggcacagaagcacaggcaagccgggggctgcactttatgaagggggtggca

SEQ ID NO: 176304 - DNA, 1156 bp, Homo sapiens
  Payload ID: 14612
  Gene Symbol: RAE1
  Gene Name: ribonucleic acid export 1
  ENST ID: ENST00000492498
  CDS Start-End: 157-810
cagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtag

SEQ ID NO: 176305 - DNA, 3595 bp, Homo sapiens
  Payload ID: 14613
  Gene Symbol: RAVER1
  Gene Name: ribonucleoprotein, PTB-binding 1
  ENST ID: ENST00000293677
  CDS Start-End: 83-2353
gcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaa

SEQ ID NO: 176306 - DNA, 742 bp, Homo sapiens
  Payload ID: 14613
  Gene Symbol: RAVER1
  Gene Name: ribonucleoprotein, PTB-binding 1
  ENST ID: ENST00000591969
  CDS Start-End: 1-290
ccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctg

SEQ ID NO: 176307 - DNA, 500 bp, Homo sapiens
  Payload ID: 14613
  Gene Symbol: RAVER1
  Gene Name: ribonucleoprotein, PTB-binding 1
  ENST ID: ENST00000593136
  CDS Start-End: 1-393
ggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggtctcactgctgggggagccccccaaggactaccggattcccctgaatccctacctgaacctacacagcctgctcccggccagcaacctggcggcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtccc

SEQ ID NO: 176308 - DNA, 1952 bp, Homo sapiens
  Payload ID: 14613
  Gene Symbol: RAVER1
  Gene Name: ribonucleoprotein, PTB-binding 1
  Uniprot ID: Q8IY67
  ENST ID: ENST00000615032
  CDS Start-End: 132-1952
ttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaaggtacgggcagggggtggggacatgcagggctgggaagccccggccccccagcggcccctgacccgccccgccctgccctctgtctccagaccccactgggcggccagaaacgcagctttgcccacctgctgccctcgcccgagcccagcccagaaggcagctatgtgggccagcactcccagggcctcggcggccactacgcggactcctacctga

SEQ ID NO: 176309 - DNA, 3501 bp, Homo sapiens
  Payload ID: 14613
  Gene Symbol: RAVER1
  Gene Name: ribonucleoprotein, PTB-binding 1
  ENST ID: ENST00000617231
  CDS Start-End: 40-2259
cccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaa

SEQ ID NO: 176310 - DNA, 3586 bp, Homo sapiens
  Payload ID: 14613
  Gene Symbol: RAVER1
  Gene Name: ribonucleoprotein, PTB-binding 1
  ENST ID: ENST00000611074
  CDS Start-End: 81-2351
ttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggtttt

SEQ ID NO: 176311 - DNA, 4398 bp, Homo sapiens
  Payload ID: 14614
  Gene Symbol: RAVER2
  Gene Name: ribonucleoprotein, PTB-binding 2
  Uniprot ID: Q9HCJ3
  ENST ID: ENST00000294428
  CDS Start-End: 79-2154
cccgggcctcctcccgctttctctctccgcttcccctggagcctccgaggagtccgcagccgctgggcgcccgggaagatggcggcggcggcgggagacggcggcggcgaggggggcgcgggcctgggcagcgcggcggggctggggccggggccggggctgcgcgggcagggcccctcagccgaagcgcacgagggcgccccggacccgatgcccgccgcgctgcaccctgaggaggtcgccgcgcgactgcagcggatgcagcgggagctgagcaaccgcaggaaaatcctggtgaaaaacctgccccaggacagcaactgccaggaagttcatgatttgttaaaagactatgacttaaaatattgttatgtggacagaaataaacgaacagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaatccatccatctctcctgcatttttacatttgaataaagcacatcagagctcagttatgggtaatacttctaatttattccttcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaacatctagcctgattccaactcaaacaacgataacagctggaatgggcatgttaccattctttccaaatcagcacattgctggacaggctgggccagggcacagtaatactcaggagaaacagccagccacggtgggaatggcagaaggaaatttctcagggtcgcagccttatcttcagagctttccaaaccttgctgctggaagcttgctggtgggacaccataagcagcagcaaagccagccaaaaggcacagagataagttcaggggctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtgtcatctttaagaaatgaaaagcgaggctcatcatatctcatctctgccccagaaggtggttcagtggaatgtgttgaccagcattctcagggcacaggagcatattacatggaaacttacttaaaaaagaagcgagtatactgagttaagctctctcctaataaccccctaaggttctctgcagtatctctgctgttcatcgctgccttaacttcattcaaactagccatatcctttaaatacgggtttatagtttcccagaaggaactgtgttgtgcagcaggcagaaatgccaaataaaaaatagcaataagaagagacatcaattgaggacattttccactagagtcagatgcatcttaatcagtgtgctaacttacaatccattggagaaactaacaatgttccaatattccttgatttaggactgggaataattctgacaccatatataaaagaagtttgaagcaataaatgggaaacagtgttgtttcctgagccttagaagaatgagtttcttataagccaatgtgcatttcaatttactttccctagaagtaattgcatttatagatttttaggacttttcctagaactacaagggtgcaagtaccaaatgtgctgatggtaatattataaagatgctctacatgcacactcaattacgcccacaccagccatgcaaaattaaacccggtaagagagtgacagtgatatccaaggtatccactactaccgatgctttaagatgttgtttaccatttataccttctgtgaaaaatagaaggtattttaagaaaagtaactttggtgatctaataaaagggtttggcaaactacaccctgggtccacatttggtctaccacccgcttttgtgctgcctgcaagctaagactaatgtttacatttttaaatggttggaggaaaaaagaaaacttatgacatgaaatttatatgaaattcagatttcagtgtccataaataaacttttattgggacgttgccatgctcattcatttacgtgttgtctgtggcactcttacgctacaagggcagaactgattagcttcaacagagactgtatggcctacaaagaccatatggcctaaaatttcaagtatctggccatttatatatagtttgctgatccctgatctaatagcactaattctaatagcaactattcctttcaattcacctaaagacagacctttagcctttagacagacttgtaagtggaaaggaacatgggtttctgtgctcatttcatagcgtagactagtaatgatctaatgactagaatggggcctattttgatcactaaatgccctattatttccacaatatagtatagtaaagcagtcaatactgcactttctgatggagtcttaaggagtcacagtatttataaccattttgagctaataagctatacctcactctctgctttctctctcactctttttgatagtgtgttagggtgaaaaatcagttatttaacccaatttacttgtgaaagaagttttatctttatggactatgatgacttttgacatcaccatttcttgaagaccttggtattaaatgcatgagaaaccttttgccatctagaaatttctaagtttgtttatgttataagactgtaattaattgatagggaatttgggatctcaatccggggctttttgaaatcagatcattaaatatctcgtcactttggggacttgttatttttaactatgatgtggatatcctgttttaattatgaagtctagaattggtacatatgttgtatgctttgtaaagaatttcacttggtctaatttattgcatatactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttgtttgttagtagtaaggaccgtaacccaccccttcctccccccaaaactatactgttatttttctatgtaagcaaattgtttgaaatgctttgaaaatgaaatcttaatattaaaaggcatatgcatgt

SEQ ID NO: 176312 - DNA, 4362 bp, Homo sapiens
  Payload ID: 14614
  Gene Symbol: RAVER2
  Gene Name: ribonucleoprotein, PTB-binding 2
  Uniprot ID: Q9HCJ3
  ENST ID: ENST00000371072
  CDS Start-End: 79-2115
cccgggcctcctcccgctttctctctccgcttcccctggagcctccgaggagtccgcagccgctgggcgcccgggaagatggcggcggcggcgggagacggcggcggcgaggggggcgcgggcctgggcagcgcggcggggctggggccggggccggggctgcgcgggcagggcccctcagccgaagcgcacgagggcgccccggacccgatgcccgccgcgctgcaccctgaggaggtcgccgcgcgactgcagcggatgcagcgggagctgagcaaccgcaggaaaatcctggtgaaaaacctgccccaggacagcaactgccaggaagttcatgatttgttaaaagactatgacttaaaatattgttatgtggacagaaataaacgaacagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaatccatccatctctcctgcatttttacatttgaataaagcacatcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaacatctagcctgattccaactcaaacaacgataacagctggaatgggcatgttaccattctttccaaatcagcacattgctggacaggctgggccagggcacagtaatactcaggagaaacagccagccacggtgggaatggcagaaggaaatttctcagggtcgcagccttatcttcagagctttccaaaccttgctgctggaagcttgctggtgggacaccataagcagcagcaaagccagccaaaaggcacagagataagttcaggggctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtgtcatctttaagaaatgaaaagcgaggctcatcatatctcatctctgccccagaaggtggttcagtggaatgtgttgaccagcattctcagggcacaggagcatattacatggaaacttacttaaaaaagaagcgagtatactgagttaagctctctcctaataaccccctaaggttctctgcagtatctctgctgttcatcgctgccttaacttcattcaaactagccatatcctttaaatacgggtttatagtttcccagaaggaactgtgttgtgcagcaggcagaaatgccaaataaaaaatagcaataagaagagacatcaattgaggacattttccactagagtcagatgcatcttaatcagtgtgctaacttacaatccattggagaaactaacaatgttccaatattccttgatttaggactgggaataattctgacaccatatataaaagaagtttgaagcaataaatgggaaacagtgttgtttcctgagccttagaagaatgagtttcttataagccaatgtgcatttcaatttactttccctagaagtaattgcatttatagatttttaggacttttcctagaactacaagggtgcaagtaccaaatgtgctgatggtaatattataaagatgctctacatgcacactcaattacgcccacaccagccatgcaaaattaaacccggtaagagagtgacagtgatatccaaggtatccactactaccgatgctttaagatgttgtttaccatttataccttctgtgaaaaatagaaggtattttaagaaaagtaactttggtgatctaataaaagggtttggcaaactacaccctgggtccacatttggtctaccacccgcttttgtgctgcctgcaagctaagactaatgtttacatttttaaatggttggaggaaaaaagaaaacttatgacatgaaatttatatgaaattcagatttcagtgtccataaataaacttttattgggacgttgccatgctcattcatttacgtgttgtctgtggcactcttacgctacaagggcagaactgattagcttcaacagagactgtatggcctacaaagaccatatggcctaaaatttcaagtatctggccatttatatatagtttgctgatccctgatctaatagcactaattctaatagcaactattcctttcaattcacctaaagacagacctttagcctttagacagacttgtaagtggaaaggaacatgggtttctgtgctcatttcatagcgtagactagtaatgatctaatgactagaatggggcctattttgatcactaaatgccctattatttccacaatatagtatagtaaagcagtcaatactgcactttctgatggagtcttaaggagtcacagtatttataaccattttgagctaataagctatacctcactctctgctttctctctcactctttttgatagtgtgttagggtgaaaaatcagttatttaacccaatttacttgtgaaagaagttttatctttatggactatgatgacttttgacatcaccatttcttgaagaccttggtattaaatgcatgagaaaccttttgccatctagaaatttctaagtttgtttatgttataagactgtaattaattgatagggaatttgggatctcaatccggggctttttgaaatcagatcattaaatatctcgtcactttggggacttgttatttttaactatgatgtggatatcctgttttaattatgaagtctagaattggtacatatgttgtatgctttgtaaagaatttcacttggtctaatttattgcatatactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttgtttgttagtagtaaggaccgtaacccaccccttcctccccccaaaactatactgttatttttctatgtaagcaaattgtttgaaatgctttgaaaatgaaatcttaatattaaaaggcatatgcatgtaaa

SEQ ID NO: 176313 - DNA, 2531 bp, Homo sapiens
  Payload ID: 14614
  Gene Symbol: RAVER2
  Gene Name: ribonucleoprotein, PTB-binding 2
  ENST ID: ENST00000418058
  CDS Start-End: 124-624
agtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaatccatccatctctcctgcatttttacatttgaataaagcacatcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaagctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtaaataattcccaggttctgatgatactcagaaaaattggttcaactatatattgagttcactgaatatgaaattgtgatttctatattattaacgtaggcaaatcaaattgcactgatctatgtatttcttactcatcatttgaaatttgggaatgtgttcaagacattatttagtatcattttgcactagatatttacctctcactgtttacctagtggttggcaaactacagcccatagaacaaatctagcccaccacctggttttgtaaataaatttgtattgtaatacagccatgtccattcattaacatattgtctatggtgctgtcatgctataataaaagagttgagtgatgacagtagagactatgtggcctgcaagattaaatatttactatctggttctttatagaaaaatgctgctaacctctggtttgcactagtgtagacctaagaaacccaagggaatgcctctgttcttctccactgattgtagatggagaaagatgatcatatttacagacactactgtgctaacttctaaaccagccaatcaataacataaaaatattatgttcataagatgtcctgtgtcattacttaaatatttcagttttgctttggcccttcttcagcttactcttagtggtgtaagctgaatatatatcatgttagccctgtgtgattatggaatcataagagtccacaagagtcttataattatcagttctgactcttactttcctagaacagccagcttcttctcagatctatcctgttcgttggagtcttgtctccactttgatttccctggagcagctttgtgtttgcctgacccatccctaataaacttagaaaagaaaaccacttagaacaattgacgcctgattataagagtactagaaacagcccaagttctgtaaaaatggtgcagctggatattagtgaaatatttgccatctcttatatacctgggacaagacggaaaaatatgggttgggtagatgatgtaattaggtgacagtatatctatatttagagaacagtgatcacaaattgctgcagtctgaaggcattctcttatattgattcataagagtcatcttcagtcctttattagataacatttgaagtaatgacttagataaagacattaattgtaaaatttacaagatatagtcctgtacaattccaatttgtttcttttcaagaaacaaactttttataaacaggagaagcacaataaattttttaaaaattcattaaatacatatttaagctttaaaaattttttgaacttttatttctttttaaatttgcctttttcttagcagttttgcttattagattactgtgatttattgtatacttatatccatggaaagactttctcattcacacatggagaaattctgtgataatgatgccttttgcattactgtatgtcttctgcctccacacttgcttgcccagagatatggtggggaaatgaatcctccctgcactgttcagtgtctcctttgacagtccctgcttctagcgcacgcttgttcataaaatgggatttgttctctctctcgtgttctttcttccttataaacttaattaaatgttactaatggaacattaaagtacatggaattaaactaatggaatactaaaat

SEQ ID NO: 176314 - DNA, 3076 bp, Homo sapiens
  Payload ID: 14615
  Gene Symbol: RRM1
  Gene Name: ribonucleotide reductase M1
  Uniprot ID: P23921
  ENST ID: ENST00000300738
  CDS Start-End: 205-2583
gtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtga

SEQ ID NO: 176315 - DNA, 2075 bp, Homo sapiens
  Payload ID: 14615
  Gene Symbol: RRM1
  Gene Name: ribonucleotide reductase M1
  ENST ID: ENST00000534285
  CDS Start-End: 300-2012
agggaagtctcgctgtgccaaaggtgcagcgtgcttttatggatgctgggtgaggagtggtcagggtaggggcagggtcggttgagtttcacgcttctgagtgtgacacgccctagtgggcatgtgcgttagtcggggtggcaggaacaggaaaggtgaacccggaaatgctgagtcagggtgtccgaggtggcgatcgccatcttggagtcttcaccggagtccaatcactgtgaaccaaaaacgaagtcaaataacaagtttcacactttgggaggccaagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagatagg

SEQ ID NO: 176316 - DNA, 783 bp, Homo sapiens
  Payload ID: 14615
  Gene Symbol: RRM1
  Gene Name: ribonucleotide reductase M1
  ENST ID: ENST00000528442
  CDS Start-End: 1-392
aaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaagagaattatgatttatttaccactagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgag

SEQ ID NO: 176317 - DNA, 2863 bp, Homo sapiens
  Payload ID: 14615
  Gene Symbol: RRM1
  Gene Name: ribonucleotide reductase M1
  ENST ID: ENST00000533349
  CDS Start-End: 171-284
ttgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtg

SEQ ID NO: 176318 - DNA, 3166 bp, Homo sapiens
  Payload ID: 14615
  Gene Symbol: RRM1
  Gene Name: ribonucleotide reductase M1
  ENST ID: ENST00000532170
  CDS Start-End: 215-424
ccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctggtctcactctgccacccaggctggagtgcagtggcataatcacagctcattgcagcctcagcttcccgagtagctgggatcacaggctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttct

SEQ ID NO: 176319 - DNA, 2381 bp, Homo sapiens
  Payload ID: 14615
  Gene Symbol: RRM1
  Gene Name: ribonucleotide reductase M1
  ENST ID: ENST00000533495
  CDS Start-End: 135-362
aaatgctgagtcagggtgtccgaggtggcgatcgccatcttggagtcttcaccggagtccaatcactgtgaaccaaaaacgaagtcaaataacaagtttcacactttgggaggccaagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaaggtatgctccatgaattgaaagtactggaaatcagaactaaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtg

SEQ ID NO: 176320 - DNA, 3271 bp, Homo sapiens
  Payload ID: 14616
  Gene Symbol: RRM2
  Gene Name: ribonucleotide reductase M2
  Uniprot ID: P31350
  ENST ID: ENST00000304567
  CDS Start-End: 70-1239
gggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataatttttttttttttttttgagatggagtctcgctctgttgcccaggctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtcagttt

SEQ ID NO: 176321 - DNA, 3673 bp, Homo sapiens
  Payload ID: 14616
  Gene Symbol: RRM2
  Gene Name: ribonucleotide reductase M2
  Uniprot ID: P31350
  ENST ID: ENST00000360566
  CDS Start-End: 292-1641
gctcctcacgcaatcctaaacggttcccgggcgaaccggggcccgcgcgcgccaaggccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgaaaatcgcgcgcggccccgcggccagcctgggtaggggcaaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataatttttttttttttttttgagatggagtctcgctctgttgcccaggctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtcagttt

SEQ ID NO: 176322 - DNA, 1060 bp, Homo sapiens
  Payload ID: 14616
  Gene Symbol: RRM2
  Gene Name: ribonucleotide reductase M2
  ENST ID: ENST00000474701
  CDS Start-End: 193-1060
ggcggcccctccccagggctgcctcccgcgcccctcggcccatttcccggttcgggcgtgcgctcctctgctgcgacccacggagtgcgacgggacagccacgttttcacatcgggccccgtgaaattgccgccaatggaaaggacttggtccagaaaaacgttagtttcatatggttcgcccggtacttaaatgttttattttctcccccaacagaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaagg

SEQ ID NO: 176323 - DNA, 3434 bp, Homo sapiens
  Payload ID: 14616
  Gene Symbol: RRM2
  Gene Name: ribonucleotide reductase M2
  Uniprot ID: P31350
  ENST ID: ENST00000615152
  CDS Start-End: 52-1401
aaaatcgcgcgcggccccgcggccagcctgggtaggggcaaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataatttttttttttttttttgagatggagtctcgctctgttgcccaggctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtcagtttc

SEQ ID NO: 176324 - DNA, 4931 bp, Homo sapiens
  Payload ID: 14617
  Gene Symbol: RRM2B
  Gene Name: ribonucleotide reductase M2 B (TP53 inducible)
  Uniprot ID: Q7LG56
  ENST ID: ENST00000251810
  CDS Start-End: 245-1300
ggctggccgaagttaggcggagccccgaggcgggggaggcggggccgggccggcgcagggagagtcactcaatggacaggcgagaaagcaggaccggcgcggcggggcggggccggccgagtccctagagctgggggcggggcggacccagcggaccagcggaccacctgggtgctgtcgtagttggaggtggcctgaggagctcagttccctcagcgcccgtagcttcggcggagtctgcgcgatgggcgacccggaaaggccggaagcggccgggctggatcaggatgagagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctctcgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattaggattaggatgcaaaaataaatgcttaaccaacactactactgttagcaccactactaattatcattcattgataatattaattgcaatgatgttgtaataaaatactctcatttccttaaaataattgtgattctaggtcctaggatctagaattagatctttgtatttttaatgcttaggggaagaatataagtatctccttaaaaagaacataattctcattcacgcaagaataagttctttgaattccttagtatgtagtgaagaaaatttagttgttagttgctttgggaagcctacttatggagtggaaaccaggaggttatcatggtagttgaccttataagaaaaatgattcttcttcagaaattaaaaacataactattgccagatttagctctggaatgtttagaatcaggctagaatagcattttccaaagaatattctaagagctattagctcctctagatatttttttgggggaaaaaggggattctgtggtcagatgagtttgggaaatgctgaacacttcattcttctttagcaagtacagtcagtacatcaaagactgagcagttcagtggtacataaatttatctcgccctgcatattcccaacatacttaacacagatgttttttacctgttaacatctcacccagctagtgttcctcagaacaaagattggaaaaagctggccgagaaccatttatacatagaggaagggcttatggactgagaaagggagaacatggtagggattattgaatcatttcaaatttataccagcctgaatagtgtaccagcaattgacttaggctgtgtttctttatggttttaaaactcttgagctgttataagagatagttcttttaatgtgactatgcaacatgatagccaatggtgagggaaaaggaggtttctctagaagagtctgatgaaaggccgggaaccaaggtttttgagaagtctgcccctatttatttttagtaagtatcaagaggtagcctgagcctagttagagttagacctgtctttggatgaagaagtcttaatactgaaatactgaatttttaatacattattatttggtattctgtataccccttcaagcagttgtttcccattcccaacaaactgtactttatacaattctggatgctaaaacttagagattttctctttgcataaattttggctccattctttccataacaatctaatcaaaactgggagttctcaagtgaatgcaaaaggagcaggccataactttatttgttagatacactgtcagaaacttgagatcttttggcctatgataataccattaatttttgcattgcttcagtttgccaagtgtttttacatcatctcatttgatctcaaaacagcttgacagagcaactgttattgaaatattacagatggaaagaatgaggctcagggaagttaaatgacttggccaagatctgctcatcgtcactgtctgtacagtatttttttttagaggttgtaatgtctcagatttagtcctttaccatctatgttgatttgcttttgtctatttcctcattaattgaatatactttaaatatatatattaaagtatcaaaatatagagagacatttgaactgtattcaggtaatatgtttaaagatatttatatattgccatacaaaaacttaacatttaaaactgataatatctgtaatgacatcagaatgaaagaaaaaaaattgtacagtgtatattcctttgttttgaatccaaatctttttcataggtaatgacagatgccttaatgtgaagcttatttataatagcaataaacctaactggatttggatgaagaagtcttaatactgacatactggatttttaatgcactggtttgttatttggtattctatctctttttccaggcctccaggttgcacatttatttattatgttcaatactttggttcttagttcttaaagaatcaagaagttgtgtaatcttttaaaaatattatcttgcagataaagaaaaaaattaagagtgtgtttacaactgttttctcttttttacagtacatgtatttaaatcattgctataataaagttaagttcattaggaatataaaaacttgcagttctatgatagattgcatttattaaaaatgtttcattgtatcacatagaaatatggccaggaaggacttgagaagacagtttgatccattgcttttagacaggactgggttttgctgtccaattatatacaataatagtttttcttacaactaagctggccccagccttgtcttgatattaatacatgaaatttttataattgtctcattgtctcatttagaaacatccatatttttctgctttttctattgccattttttatttgtgcatgaattgattattgagaaaatgtagcagtttgcatatttaaaaattaatcattttgcattttacatttaaatatgctaacatcactgtcatagaattcccaaatttcatttgtagatactgaactaagggctaatgtcaggagctgatttttaatgataaagctgcagatgggctaaataaaagccaaattaatcctacaatcaggtattatgtttttaaaccaagttgagtgaattggtagtggacttgggaaatcttccccagcagaatctggatgaatggcacagaattgaaatctctttgtttcccaccatttccctttaagtgctctgctcctttgtaaaaagttaaagatttgaaagagaatctcatattcccgaggcattaggaagaaaggatttaatcccttcaatttggggcttaatcttgtttaaaaaaatgtaagtgaagatggaaggctggagagaatgattgctttttgtacagttaaataaggtcacaatattcttacatactttgttttacaactgtgttttcattttttcaaatgtctggccatttagcaaagttatttactatttactgtgtacatagaaagctttattatgtgtggtgtatctaaattttttttgctgaaatacattatggtcaatcaagccaagcctgcatgtacagaatttgtttttttttcaaataaattagttgttttcttatttttttggcttagtatgttgaaataaactatggtatcttcatcattttgtacatttcctttttgaggaaggtttctttataagtgcaagggctaccctaataaaggaatgtatatacttac

SEQ ID NO: 176325 - DNA, 900 bp, Homo sapiens
  Payload ID: 14617
  Gene Symbol: RRM2B
  Gene Name: ribonucleotide reductase M2 B (TP53 inducible)
  Uniprot ID: Q7LG56
  ENST ID: ENST00000395912
  CDS Start-End: 1-900
atgggcgacccggaaaggccggaagcggccgggctggatcaggatgaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaa

SEQ ID NO: 176326 - DNA, 603 bp, Homo sapiens
  Payload ID: 14617
  Gene Symbol: RRM2B
  Gene Name: ribonucleotide reductase M2 B (TP53 inducible)
  ENST ID: ENST00000523957
  CDS Start-End: 66-263
gtagttggaggtggcctgaggagctcagttccctcagcgcccgtagcttcggcggagtctgcgcgatgggcgacccggaaaggccggaagcggccgggctggatcaggatgagatggagtcttgctctgtcaccaggcctgagtgcagtggcgtgatctcagctcactgcaatctctgccttctgggttcaagtgattctcctgcctcagcctcccgagtagctgggactacagagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagt

SEQ ID NO: 176327 - DNA, 1613 bp, Homo sapiens
  Payload ID: 14617
  Gene Symbol: RRM2B
  Gene Name: ribonucleotide reductase M2 B (TP53 inducible)
  ENST ID: ENST00000522368
  CDS Start-End: 1-1225
agattgcaagttgcaggaccgctgtaggaaatgttattcgccgcggtcaggacaggcctgtccgcccgccctcgccgcagcctggcttcgtcgttgcgagcgccggggaggccgtccccggggagggcggaggaaggagctgactttgggtttgcgtcccgctcgctgctctgccccggggccagccaaggacgacgcttggaggcctcaggccgggagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctctcgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattag

SEQ ID NO: 176328 - DNA, 201 bp, Homo sapiens
  Payload ID: 14617
  Gene Symbol: RRM2B
  Gene Name: ribonucleotide reductase M2 B (TP53 inducible)
  Uniprot ID: Q7LG56
  ENST ID: ENST00000519962
  CDS Start-End: 1-201
atgggcgacccggaaaggccggaagcggccgggctggatcaggatgaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaa

SEQ ID NO: 176329 - DNA, 389 bp, Homo sapiens
  Payload ID: 14617
  Gene Symbol: RRM2B
  Gene Name: ribonucleotide reductase M2 B (TP53 inducible)
  Uniprot ID: Q7LG56
  ENST ID: ENST00000522394
  CDS Start-End: 1-132
atgggcgacccggaaaggccggaagcggccgggctggatcaggatgagagatcatcttcagacaccaacgaaagtgaaataaagtcaaatgaagagccactcctaagaaagagttctcgccggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaa

SEQ ID NO: 176330 - DNA, 420 bp, Homo sapiens
  Payload ID: 14617
  Gene Symbol: RRM2B
  Gene Name: ribonucleotide reductase M2 B (TP53 inducible)
  Uniprot ID: Q7LG56
  ENST ID: ENST00000519317
  CDS Start-End: 1-420
atgggcgacccggaaaggccggaagcggccgggctggatcaggatgagggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaa

SEQ ID NO: 176331 - DNA, 3483 bp, Homo sapiens
  Payload ID: 14617
  Gene Symbol: RRM2B
  Gene Name: ribonucleotide reductase M2 B (TP53 inducible)
  ENST ID: ENST00000621845
  CDS Start-End: 332-1225
agattgcaagttgcaggaccgctgtaggaaatgttattcgccgcggtcaggacaggcctgtccgcccgccctcgccgcagcctggcttcgtcgttgcgagcgccggggaggccgtccccggggagggcggaggaaggagctgactttgggtttgcgtcccgctcgctgctctgccccggggccagccaaggacgacgcttggaggcctcaggccgggagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctctcgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattaggattaggatgcaaaaataaatgcttaaccaacactactactgttagcaccactactaattatcattcattgataatattaattgcaatgatgttgtaataaaatactctcatttccttaaaataattgtgattctaggtcctaggatctagaattagatctttgtatttttaatgcttaggggaagaatataagtatctccttaaaaagaacataattctcattcacgcaagaataagttctttgaattccttagtatgtagtgaagaaaatttagttgttagttgctttgggaagcctacttatggagtggaaaccaggaggttatcatggtagttgaccttataagaaaaatgattcttcttcagaaattaaaaacataactattgccagatttagctctggaatgtttagaatcagtacatcaaagactgagcagttcagtggtacataaatttatctcgccctgcatattcccaacatacttaacacagatgttttttacctgttaacatctcacccagctagtgttcctcagaacaaagattggaaaaagctggccgagaaccatttatacatagaggaagggcttatggactgagaaagggagaacatggtagggattattgaatcatttcaaatttataccagcctgaatagtgtaccagcaattgacttaggctgtgtttctttatggttttaaaactcttgagctgttataagagatagttcttttaatgtgactatgcaacatgatagccaatggtgagggaaaaggaggtttctctagaagagtctgatgaaaggccgggaaccaaggtttttgagaagtctgcccctatttatttttagtaagtatcaagaggtagcctgagcctagttagagttagacctgtctttggatgaagaagtcttaatactgaaatactgaatttttaatacattattatttggtattctgtataccccttcaagcagttgtttcccattcccaacaaactgtactttatacaattctggatgctaaaacttagagattttctctttgcataaattttggctccattctttccataacaatctaatcaaaactgggagttctcaagtgaatgcaaaaggagcaggccataactttatttgttagatacactgtcagaaacttgagatcttttggcctatgataataccattaatttttgcattgcttcagtttgccaagatctgctcatcgtcactgtctgtacagtatttttttttagaggttgtaatgtctcagatttagtcctttaccatctatgttgatttgcttttgtctatttcctcattaattgaatatactttaaatatatatattaaagtatcaaaatatagagagacatttgaactgtattcaggtaatatgtttaaagatatttatatattgccatacaaaaacttaacatttaaaactgataatatctgtaatgacatcagaatgaaagaaaaaaaattgtacagtgtatattcctttgttttgaatccaaatctttttcataggtaatgacagatgccttaatgtgaagcttatttataatagcaataaacctaactggatttggatgaagaagtcttaatactgacatactggatttttaatgcactggtttgttatttggtattctatctctttttccaggcctccaggttgcacatttatttattatgttcaatactttggttcttagttcttaaagaatcaagaagttgtgtaatcttttaaaaatattatcttgcagataaagaaaaaaattaagagtgtgtttacaactgttttctcttttttacagtacatgtatttaaatcattgctataataaagttaagttcattagg

SEQ ID NO: 176332 - DNA, 2314 bp, Homo sapiens
  Payload ID: 14618
  Gene Symbol: RPN1
  Gene Name: ribophorin I
  Uniprot ID: P04843
  ENST ID: ENST00000296255
  CDS Start-End: 50-1873
gctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaagatatttttcagcctataaagccccctgttttatgcccttctaattctgatgtttgggtattgtgtgagtgcatgtgtttttttttttttttttaaagcgtgtgtgaacaaatggaaataaagcagggactgtgaacatt

SEQ ID NO: 176333 - DNA, 2137 bp, Homo sapiens
  Payload ID: 14618
  Gene Symbol: RPN1
  Gene Name: ribophorin I
  ENST ID: ENST00000497289
  CDS Start-End: 578-1885
catcttttacaagaaaccttcgctgcaaccgctgcgtcacatcaccgcgtctcccagggacaggaaagcctctccgtgtttggtgaagcttcaggggaagcagtcatcctgtcgtcgcatacggcaaaatcctccattgccgtagccgttcggctgacgtgacaagggaggtgcaggccaacacggcgactccgcgccctctggcggcagtgccggagcagcggcgctgtctttgacctatccggcattcggcttccgggaccgcttggcggctgtgaatgcagagctggggcgacgtggggctcgcttcctgggactgggtgtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgtttt

SEQ ID NO: 176334 - DNA, 526 bp, Homo sapiens
  Payload ID: 14618
  Gene Symbol: RPN1
  Gene Name: ribophorin I
  ENST ID: ENST00000476931
  CDS Start-End: 21-386
gcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagggtctgttgcccaggctccattactgtggtgccatgttgactcactgcaacctccacctccagggctcaaaccgtccttctccctcagcctcccaaataggtgggactagagtgggagattcttcacagtcaagctcccagttgctcttgatcctggggccaagatttcagtcattgtgg

SEQ ID NO: 176335 - DNA, 2515 bp, Homo sapiens
  Payload ID: 14619
  Gene Symbol: RPN2
  Gene Name: ribophorin II
  Uniprot ID: P04844
  ENST ID: ENST00000237530
  CDS Start-End: 312-2207
gcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaacaaa

SEQ ID NO: 176336 - DNA, 2348 bp, Homo sapiens
  Payload ID: 14619
  Gene Symbol: RPN2
  Gene Name: ribophorin II
  Uniprot ID: P04844
  ENST ID: ENST00000373622
  CDS Start-End: 197-2044
gactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagaggatcgctgcagagcagagcagtagattggcaaaatataggacactacgaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 176337 - DNA, 1073 bp, Homo sapiens
  Payload ID: 14619
  Gene Symbol: RPN2
  Gene Name: ribophorin II
  ENST ID: ENST00000373632
  CDS Start-End: 40-1073
agcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgagggtgtggagcaccgttctggaatcccgttcgttgtttagcaagagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtagg

SEQ ID NO: 176338 - DNA, 791 bp, Homo sapiens
  Payload ID: 14619
  Gene Symbol: RPN2
  Gene Name: ribophorin II
  ENST ID: ENST00000456102
  CDS Start-End: 292-791
tgttcctggatgagccacctccatgttgagcctgtaaaactggcctaatatgttctctatgagtcactgcattgctctgcaaatcagataaaacgtcactcgtaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatc

SEQ ID NO: 176339 - DNA, 453 bp, Homo sapiens
  Payload ID: 14619
  Gene Symbol: RPN2
  Gene Name: ribophorin II
  ENST ID: ENST00000456400
  CDS Start-End: 1-442
tggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgaacagcacattagttccagaagaaagatggaaattctgaaaactgaatgtcaagaaaaggagtcaagaacaattcacagtatgagaagaaaaatggaaaaaaaaaactttatttaaaaaagaaaaaa

SEQ ID NO: 176340 - DNA, 520 bp, Homo sapiens
  Payload ID: 14619
  Gene Symbol: RPN2
  Gene Name: ribophorin II
  ENST ID: ENST00000437329
  CDS Start-End: 1-417
gaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaa

SEQ ID NO: 176341 - DNA, 712 bp, Homo sapiens
  Payload ID: 14619
  Gene Symbol: RPN2
  Gene Name: ribophorin II
  ENST ID: ENST00000462163
  CDS Start-End: 227-712
ggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatc

SEQ ID NO: 176342 - DNA, 1848 bp, Homo sapiens
  Payload ID: 14620
  Gene Symbol: RPIA
  Gene Name: ribose 5-phosphate isomerase A
  Uniprot ID: P49247
  ENST ID: ENST00000283646
  CDS Start-End: 56-991
atttccgggggagccgggggcgggacttcagcggaggccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggggcgtgcacagtctgggacccgtggcggtgctggcaacacaagcaccagctgcggggactccaacagcatctgcccggccccctccacgatgtccaaggccgaggaggccaagaagctggcgggccgcgcggctgtggagaaccacgtgaggaataaccaagtgctgggaattggaagtggttctacaattgtccatgctgtgcagcgaatagctgaaagggtgaagcaagagaatctgaacctcgtctgtattcccacttccttccaggcccgccagctcatcctgcagtatggcttgaccctcagtgatctggatcgacacccagagatcgaccttgccatcgatggtgctgatgaagtagatgctgatctcaatctcatcaagggtggcggaggctgcctgacccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctggtcctgtggtgacagataatgggaattttatcttggactggaagtttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagcttctgaatattgagtttgctgagaaataaaaatcaaaacttctttaagctggtaaagtgaggggcccaccagcagtgatctcctgatgccttactggaaactttgtttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaaataaaacagtgtggtgccattttga

SEQ ID NO: 176343 - DNA, 1323 bp, Homo sapiens
  Payload ID: 14621
  Gene Symbol: RSL1D1
  Gene Name: ribosomal L1 domain containing 1
  ENST ID: ENST00000355674
  CDS Start-End: 33-1323
gcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacagtcttaaacatttctaaaagtggttcttgcagtgctatacgtattggtcacgttggaatgcaaattgagcacatcattgaaaacattgttgctgtcaccaaaggactttcagaaaaattgccagagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagc

SEQ ID NO: 176344 - DNA, 1470 bp, Homo sapiens
  Payload ID: 14621
  Gene Symbol: RSL1D1
  Gene Name: ribosomal L1 domain containing 1
  ENST ID: ENST00000396503
  CDS Start-End: 69-188
gctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacagtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctg

SEQ ID NO: 176345 - DNA, 759 bp, Homo sapiens
  Payload ID: 14621
  Gene Symbol: RSL1D1
  Gene Name: ribosomal L1 domain containing 1
  ENST ID: ENST00000572090
  CDS Start-End: 1-281
aggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattagacgagatcttgcgctgttgcccagctggagtacaatagtgagatctgtgttcactgcaacctcaacctccctgacctgactcaagtgatcctcccacctcagccttccaagtagctgggactacaggaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacagtcttaaacatttctaaaagtggttcttgcag

SEQ ID NO: 176346 - DNA, 710 bp, Homo sapiens
  Payload ID: 14621
  Gene Symbol: RSL1D1
  Gene Name: ribosomal L1 domain containing 1
  ENST ID: ENST00000573618
  CDS Start-End: 7-150
aacaagatggaggattcggcctcggcctcgctgtcttctgcagccgctactggaacctccacctcgactccagcggccccgacagcacggaagcagctggataaagaacaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaa

SEQ ID NO: 176347 - DNA, 520 bp, Homo sapiens
  Payload ID: 14621
  Gene Symbol: RSL1D1
  Gene Name: ribosomal L1 domain containing 1
  ENST ID: ENST00000573791
  CDS Start-End: 225-520
tttccctggtcctgcggcctggcgctagtgaattgggttgcaagtgtgctgtggagctagatgagatagacctggcgacctggcttagcttccctatcattagcgcttgaccgaatcgcttagttttgcaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctctt

SEQ ID NO: 176348 - DNA, 871 bp, Homo sapiens
  Payload ID: 14621
  Gene Symbol: RSL1D1
  Gene Name: ribosomal L1 domain containing 1
  ENST ID: ENST00000570767
  CDS Start-End: 31-162
acacgcgcctcttcacgaggtggaaacaagatggaggattcggcctcggcctcgctgtcttctgcagccgctactggaacctccacctcgactccagcggccccgacagcacggaagcagctggataaagaacaggtgaaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacagtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaa

SEQ ID NO: 176349 - DNA, 509 bp, Homo sapiens
  Payload ID: 14621
  Gene Symbol: RSL1D1
  Gene Name: ribosomal L1 domain containing 1
  ENST ID: ENST00000571988
  CDS Start-End: 36-509
agaggtaatgagtgtaaagcgctttggcctggtacatggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaaga

SEQ ID NO: 176350 - DNA, 894 bp, Homo sapiens
  Payload ID: 14621
  Gene Symbol: RSL1D1
  Gene Name: ribosomal L1 domain containing 1
  ENST ID: ENST00000573251
  CDS Start-End: 5-894
caagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaatgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaa

SEQ ID NO: 176351 - DNA, 5483 bp, Homo sapiens
  Payload ID: 14621
  Gene Symbol: RSL1D1
  Gene Name: ribosomal L1 domain containing 1
  Uniprot ID: O76021
  ENST ID: ENST00000571133
  CDS Start-End: 74-1546
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacagtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatgatggagagcaggttcttttaactcaagttacagtcgatcctgggagagcaaggagccagcaagtctagacattccagagccacaggccctggattttatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccagctacttgggaggctgaagcaggagaatcactttaacccgggaggtggaggttgcagtgagctgagatcacaccactgcactccagcctgggcggcagagcaaaactgaaaaaaagagaaaaaaaaaaacatctagctctccctgaaattagaggagtctagcctgcttttgctgtttttttggtagcgagagtagcgggcagtgggggagatggtcttactctgttccccaggctggagtgcactagtgtcatcacagctccagcctcaatttcctgggctcaaggcgatcttcccacctcagcctcccaagtagctcagactacaggggcatgccatcacagctggccagtttttacgtcttgcgtagagatgggttttccctgtgttccctaggctgggctcgaactcctgggctcaagtcctcctgcctcagcctcccaaaatgttcagattacaggcatgaggcagcatgccaatcctgtttttgcattttagtaacacaaattgtaatgttaactttttaaattatgaaagcatctaaaatataaaattatttgtaaccccactgtccttttgggcttctataaatgaatatacatctaaaatgtgggggtttagcttaattgattgttttccatagaaactaggttttatgggaagatggttggatagacttgtttcacttaaaggtctggtttgtgtaggacaaacccacatatgtaatcgtgccagtctgttctctgcatgacataattttccagcaatagctgtgtggtttttgtaatcctatcatctagtcagttcaagatcttgcaacactgtgtgattctttgctccgtagttcagtcttgttgaacatgacacaggtgtttactttcctgttcttgcatctagtttcattctaataatgttctctgttgaaaaagctggcttcaatttattgagcaagatgctggtgttatcatctaacataaaacctatcttataataaagtgttgacacatgtaatgagtactgtactgaaaaatggtggtatgtatatggtttgtactgattatgtatcgcttttataccatcaaaaagttgaaaaatcataaagttgaatcatcctaaaatgggtacattctgtactatgtttccaaggcttcagaagtgttgcatacacattcctagccagctgatagtgctaggagccaacagtagtctcccccgggggccaagaggagggcgaaatctctactatggtatatgatgttctcgtgggccaagtatgagggtgatatttcattgttggcactgggtttctggaatccatcctcttcaccagggagatttaatgaaccaaatgagatctgatgggagaaatttgagtgtaacgtttttgttctgaaggaagtaattgagttttagttcatttgttttttaggaatcgtaataattaaaatttcattttaaatgcca

SEQ ID NO: 176352 - DNA, 766 bp, Homo sapiens
  Payload ID: 14621
  Gene Symbol: RSL1D1
  Gene Name: ribosomal L1 domain containing 1
  ENST ID: ENST00000573029
  CDS Start-End: 7-147
aacaagatggaggattcggcctcggcctcgctgtcttctgcagccgctactggaacctccacctcgactccagcggccccgacagcacggaagcagctggataaagaacagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaag

SEQ ID NO: 176353 - DNA, 2015 bp, Homo sapiens
  Payload ID: 14622
  Gene Symbol: RSL24D1
  Gene Name: ribosomal L24 domain containing 1
  Uniprot ID: Q9UHA3
  ENST ID: ENST00000260443
  CDS Start-End: 178-669
cacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaatgctgatatttattctttaaaggcactaaacaaagatatgaaatattgatgacctggaagaagaaatcttcctccacacatcccatttaagtaggagatacatttaattaaagagaaatagatacttaatacttaatgttttgtgtttttacattgtttacagttttaagtatgttaaatacattaagtaacgatcagtttgcataatggtttttttagggtagagtttaaaatcagtaattcttagccttacataattataaagtaatggctcattttttgtttcagtattagatagtaaaactaaggctgtagaccagtccctggaccaagtgttaggagacctgagttccaatgtggttttgcctgggtattcttatttgtaaataatattattgattgaagattaggggaaatgatacatgtgaggaaagacatttgtaaaatttcttgggtttttactacataccgtattcattttttaaagaaataaacattttgaaagtta

SEQ ID NO: 176354 - DNA, 442 bp, Homo sapiens
  Payload ID: 14622
  Gene Symbol: RSL24D1
  Gene Name: ribosomal L24 domain containing 1
  ENST ID: ENST00000569386
  CDS Start-End: 244-442
gtcttccgagcggcgctggccaccacgccacccttgggtggcgttggcagcgaggaacttcaggagcgatcccagctagcgcctaccaggaatcttggatgtctgtgagggctgtttggccactcatgtacttgggccaaattcttgaatccagtaaactttgttgagtgtataccctgtcaggcattacactaaggtccatactaaagtgtagaggttgatggaagtgttccgtattgcttaatggtagagttatgtattaagttactgcaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgag

SEQ ID NO: 176355 - DNA, 940 bp, Homo sapiens
  Payload ID: 14622
  Gene Symbol: RSL24D1
  Gene Name: ribosomal L24 domain containing 1
  ENST ID: ENST00000562993
  CDS Start-End: 25-276
ggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggtgagtacggttagctatcaatatagtttttacacgtttcacagttttagtatttgaagggtatatgtcatctaatcaatcataacaaggcctcctataacatgattaataagtaccttatttgtatttggctgtggaaataatctcattctcacatgatccttaaaactgtaattctgtggagctactatttttagctcttgcagaccaagaggaaaatcacttaaatggcttgggatgaagttgggaattgctactgaaagattttgagatgaagttaagagataaaggatttctgaacagcagtcaaggctcaggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcga

SEQ ID NO: 176356 - DNA, 864 bp, Homo sapiens
  Payload ID: 14623
  Gene Symbol: RIMKLA
  Gene Name: ribosomal modification protein rimK-like family member A
  ENST ID: ENST00000410070
  CDS Start-End: 574-864
gagacgcctggcgcacccgcgggagcggagccgtggcgcgctcgccccggacgccggccgcccctccgctcgccctactgagcgagcggcccggggcgccgaggggtccgcgccgcgcggggcgcaccgccctggccgccatgtgctcccagctctggttcctgacggaccggcgcatccgcgaggactacccgcaggtgcagatcctgcgcgccctccggcagcgctgctccgagcaggacgtgcgcttccgggcggtgcttatggaccagatcgccgtcaccatcgtcggcggccacctcggcttcagttggaatgagccaggcccaaagatttacctttggagaagagagatgaagtcctggcctccagctaaaccagaaggccctcaccactttcccggatgtggtgcttgtacgggtacccacaccctcagtgcagtcagacagtgacatcactgtcctgcgacacctggagaagctgggctgccggttggtcaatcgcccacagagcatcttaaattgcatcaacaaattctggacgttccaagaactggctggacatggggtccccatgccagacaccttctcctatggtgggcatgaagacttttcaaaaatgattgatgaagctgagcccctgggctacccagtcgtggtgaagagcacacgaggccaccggggaaaagctgtttttctggcaagagataaacatcacctctctgacatctgccatctgatccgccacgatgtgccctacctgttccagaagtacgtgaaggagtcccatggaaaggacatccgggtggtggtggtagggggccaggtcataggctctatgcttcgctgctccactgatggacgg

SEQ ID NO: 176357 - DNA, 8909 bp, Homo sapiens
  Payload ID: 14623
  Gene Symbol: RIMKLA
  Gene Name: ribosomal modification protein rimK-like family member A
  Uniprot ID: Q8IXN7
  ENST ID: ENST00000431473
  CDS Start-End: 130-1305
cgcacccgcgggagcggagccgtggcgcgctcgccccggacgccggccgcccctccgctcgccctactgagcgagcggcccggggcgccgaggggtccgcgccgcgcggggcgcaccgccctggccgccatgtgctcccagctctggttcctgacggaccggcgcatccgcgaggactacccgcaggtgcagatcctgcgcgccctccggcagcgctgctccgagcaggacgtgcgcttccgggcggtgcttatggaccagatcgccgtcaccatcgtcggcggccacctcggcctccagctaaaccagaaggccctcaccactttcccggatgtggtgcttgtacgggtacccacaccctcagtgcagtcagacagtgacatcactgtcctgcgacacctggagaagctgggctgccggttggtcaatcgcccacagagcatcttaaattgcatcaacaaattctggacgttccaagaactggctggacatggggtccccatgccagacaccttctcctatggtgggcatgaagacttttcaaaaatgattgatgaagctgagcccctgggctacccagtcgtggtgaagagcacacgaggccaccggggaaaagctgtttttctggcaagagataaacatcacctctctgacatctgccatctgatccgccacgatgtgccctacctgttccagaagtacgtgaaggagtcccatggaaaggacatccgggtggtggtggtagggggccaggtcataggctctatgcttcgctgctccactgatggacggatgcagagcaactgctctctcggtggcgtgggcgtcaagtgtccgctgacagaacaaggcaagcagttggctattcaggtgtccaacatcctaggcatggacttctgtggcattgatctccttatcatggacgatggctcctttgtggtgtgtgaggcaaatgctaatgttggcttcctagcctttgaccaggcatgcaacttagatgtgggtgggatcattgcagactataccatgtccttgctgccaaataggcagactggaaagatggctgtcctcccaggactgtcgagtccaagggagaagaacgagccggatggctgtgcttcagctcagggagttgcagagagcgtctataccatcaacagtgggtctacctctagtgaaagtgagcctgaactgggagagatccgggattcctcagcaagcacaatgggggccccaccctccatgctgcccgaacctggctacaacattaacaacaggattgcttctgagttaaaacttaagtgaattcctgctttttggcagcatttaaaccaaatcctactgcttccctagtagttttgagtgaataaaatctggactaatgtgatttcatttgcacagaaactagaaatcccatctgggcactcagcattttttctaacgatgatttaagcaaatggcctagctttgtggtttttacaaagacaaatataaaaacactcaagaacaacgtcccgactgatcagtatgagactgatgtctgctgtgagcacgtggatattacggctgacgctaaggcactgactctgctgttgcttctgacttttagcagtagaacccattagctcaaaatggctcttggaattatgtactcaaaagcaaccacgggatggaagcatgtgcagacgaggtggaatgtgactgcagtaataggttcttcactaagtgtgtgtgtgatgcttggaaaagacacagttcaaacactattagaggatcgatctctgctccccatcaatcaccatcttgaccatatttctccgacactcaggatatggtgttttagggagcttcctcattagcattttcagtgaagcactttgtagaaagtgagattgaacgttctttgacttcacaggttggcaaatgtcctgctttgtaactgggcctttctacaaattgctttgccactctgaatttatagaccctgcttcaactaacgtcagctctagcagcttcttgcacctttgctgcctttggcctcagctggaaatgcacttcaatgagctagtggccactcagtttatttcttaagcgtgcactagaatctaacaccatggactttgtttttcaatggactctgttcacttgtcatccagaagccagtgggtttttaccatagaaagctacttggagatcatcattcttcccctcctctactgaaactttgtgtactgcttagctgtagggggttttcttgtatgagtgggtgttggaggtctattgagtagatgggagccattggaaacactccaatccccttgaaactctacttttatctaagatccagacacctgtccttacccacttttccaaacggggaagactcaggtatcaggaattacccattgcacattttgcgggggggggggctaatgtagacatgacaccaagtgcttttcattttaattctctaagcagtagatgagatctttcccttgggagaaatcacagagatggagttttccatttctgcttatacgaaatatgactgaaaatgaacaaagccacctttttaaccaaatacactagaacatatgcactcaagagttagcataattggagttattttcttgatgttgcatgtgccaagaacacttagggttcccctttgggattacctttgaagccatgcaaggcaagaggcctcacaactttatagtcagaccttgtgttttatccaacccctcctcctgcccaccaagatcatcctgagctgcttcacccattttatttagcagacttattttctaatgctctttagctgttaaaaaaaaaaaatcattcctcaaaaaatagatctacccttaaaggacaaagatttaccaacactgaagacccttacaagttgacagtttctaaagagggttctaggaatgttctgtgtaaggtcagcttcactggaataaacatacatcttcccaaggtgactacttcaaaggcaacactacccattcgggtgcagaaattaccgtacttactctgccataaatgtaaaatgtgtataaagttaagctattgcattttttcataacacatttaaatagaaattggcttttaaagtattgtagttaaaaccagatctcaccaagtaatagttgtgcaattgacaaatgtttggtgccatgtaatggagatgtcacactacacagttgtagtttaaatgcagtccaacataaggtgcatgccactgaactgtaaccctagtaatgtgtcttgtacagttgaaaaataatacttcacctttatataggttaagatatgtaccttatctttaccactcagggtggctttaaaagacggacagctttaggtttgttctcactggaactggttacactttctgtgcaaacttaaccaagtgatgatcgtctggaagctgcattccctcatttccactgtttggtgtgaatctagtctccccactttatctaaaaggaggctagcagggccccagcctgagcagagcagctagagagtgcttccagattcctttgccaaaggaggcccattttccagctgtgagtgacatctgtagtcattggcttcattgcctggcactagccctgtctagaagtggagaaagctggatcacagctggaccacaaccagccccaatccaggatttcccataccatgctggctgtgggctctgtgagcctcagccaggtggccaggctatacttgtcacagctggccacaggcctgctgaaggaacatggggtgtagagccagagcctggttctggttctccgcttgaacagctgacctcgtgcaatcacaggaactctgcgtctccatgtttcactcagatagagaaaatgcctcctttgtttacctctttgaagctgaagtaagtgagactggtgcatgtaaattaatggtagtagagcacctcccacatctgattttataacagtttcccatcactccttaaagaaaaaggccaggccgggcgtggtggttcacgcctgtaatctcagcacttcgggaggccgaggcgggtggatcatgaggtcaggagattgagaccattctggctaacacagtgaacaaaaaattagtcgggcatggtggcgggcgcctgtagtcccagctacttgggaggctgaggcaggagaattgcttgaaccttggaggtggaggctgcagtgagccaagattatgccactgcactccagcctgggtgacagagcgagactccgtctcaaaaaaaaaaaaaaaaagccacacattcttggcattagcacaccaaacagtggtagggtaccctgagaaaggaatgcagcttctcagaggcctcacttccagccagggaaacttaagacctgaaaggaataaggctctttgtgtattcagacagccttctggatgtatcgtatataacctgaaactctccactcttgtataccaactaacaaagtcttccttatgtaacatagattgcagtgtctgtatatggtcttcccattatctggtagtagcatcttgaaactggtcaaaacttgaatgccaatagctcagtcactcagaatatacgattctgcacttgggaaaaatgtcttcatgctgtttttctgatcgggtatggggttgccagaatgaggatttggggctttaggtctttcggatctcagaaacaatataagtagatcataagccactagtgtcacaatttcaggcccattgcttccagctaaaaggagattccatgaccatggggaccaggagaggaggaaagggaaaagggaaaggtctggaatagttttgtgaaagaaataaaaaattgggatgatttggaattctagtaggaaggaggaaaaaatggctcttctgtgggctgttttaatgaaagaatcatgaatatgtattgatcagaggtagatgtctttgaagctgttctgcataaagataatgagatgcatggatttccatccaccctggagaagtgggggagatgtgcttcctcccttctttaaatcctgaggaatgctggtcttgagaacactgaatgcaaatctgaggaagatgtaagcggctggctggggagttttaggaccacccaaataaaagctgaccctcccagaggctaatgaaccacagtgctgtgtgcaggcatagccttagcaggtcagtttaaggagtcaggtcagagaataaatccaaccttagtcaagtcactacagtttaatattttcctttgcaactggaggtaagcctgtttgccattagtctgagtggatgtcttgggaaggcccctgaaaatagccatatttgtcactgtccctaaagtgaatgttcatagatctgggactgtttttgactgtacctctgagactcaagatcaggacagattgttactttaaaatgttacctggaagacgattcttctaagggctataatgttataatcttttcctaaaactaaatcatgcctccattccaggtctatggctagactctgcagccctccctcctaaaaccacagggctgaatgtggaaactttcttcttttaagcctttccatttccttctctaggtacagctcctgtgccaatatgcactgtctcaagccctgtgctggcattccaacctggtttggtaattttgctgtgaggttcatgttctctggggctccagggcaacactaagaaagtcgcttatgatccccatttgagaccatggaattagcattttggagaccagtctagtcccccatttcataagtagggaatcttacttagttccagaggccatgttcacttgctagtcaatagcaaggctggactcaggcagtctgattcctcatccactttggcatactgccagaggtagctccatccctccctggaatctagcacatgctcccatcctgggcctaccctccgcctcctccccttctgatgagcctctgttctggatcaacacggtgttgatgtgccagctgtcaagggttcagcacttggatggcttctaggtgagagccccaaaggcatgtatatttccatgatgcaagctggctcatggcccgcaccgtctttagaccagccaagaccatttaactctaccccacactttcagtggtgggatgtgaggaagaaagcccatgccaagctaactgaaagcttatttggctccaattcggctgatgttccctcactgcagaatgtcctggaaaccaagggtttgcagctcctaaacctattgcattaggcacacccaagaagaaatcctgttcgatgcacatgctccagtttcaatcagcaacaaggtcaaaagtttccccccactttctgttccacagtgcgttccccttgcagccagacattaggcacagattcatccctattgtaacccaaatgtcagctgagggctccttgcctcttgacatccagagaggtctgataactgggctctgtttctgaacctctagatttctgtgatttctcaaagacttatatttttgcagccactgctgactccacacttctgctacctcattttaaatagcgtcttatccctgcaatgcatcagctgagacatgaagctcagtttcctcgcccatttccacatagcaaaattcaagcgagtgagtgtgtgtgcctgcgtgtgtctcagtgacgtgggaaggaatggcagatgctacaacagtgcagactcggcaccccatttatagaatgttctttttatatactatggaggaatctccactcaccttccactccacgtggtccctgtctcctgtccttgggacagagcagttccatttatattctcacatacaaccagatggatagccattccttttcttaatttgattcctgccaacaccctaaccgtcatgacttcaccttttaccatgggtggcttattaaaaacattttcctggacgaagacagttccctccccaagcggaattcgagtgccatctcttaaggtgatgcatttttaattcccactgcacaagccaggcatcacaatgaccatattcaccactcgttgtcaggggtacaccttttggaaggcagcgtgggctaatgtgaatggtactagtctgagtcagatccagttcaaatccaggtaacttaaagcttgtgtgacccagggacactttacttcaacttgttaaaccttaattttgtcacctataaatgtgatacataaacaaacttgaatgtgtcgcacttaaccacatgcctggctttccataggttcctttcctcttgcttcccccactgtgagcaacacaagcatcgccttcttgtgatcatggctcagtgccaagggataaaagctggcagacagcagctttacagctgggaaaaagagctgctgggggcagggctggcggtagctcaagcatgctgtggttcaggctaatgactggaaggtcccatccatccttgagattttatgacgctatgtgcaagatctagcgaacgtatttggctaagaaaaatcctggaggagagactgcctcagacaactggggggctggaaagccgacctggaaagcagcctgaccttggatgatttagcacctgggttttttggctcttcctgtattaggtttgctggcttcgcatcaaatggaaggaggtggtgccagggacgtgaattaaacctgtcaaatagagggtgaggggagtgcagaaggctgggggaaggaggggctgtgtggggaactctgatagtctgacagcaccatctggacttggcagggatgacagccctgagatcagatggaactaaccaataaagctgctaaaattctgctgtcctgggcctatccggagtgggactcccgtaatctcctatttagaaggaacactgatctgcaaggggagagctggggcccttaatcattctgcagagctgataacggtcactgtggaggcaggactaggcgggtgcctggtttgcttagtcccaccttgaggtcccgagttccagtggtgtgccgaagtggtttgcactggcccatgagagtggattgttgaatttccaggaattttgtaagctggttggtaaacacagccacagtgaccattagagattatattaacctgcaattaaataaagtatgttaaaaacagtaataaatactcaaaactcatcacttcctaattattttactattatctatgttcttgaggatactgacatctattgtattggtatggtgtgctacaatataatggcgtgctattgcacatctcttcccaacctgaacattcagtgacatcacatcagtagctggggaatcggccctattgagagtatttacaccacagagattggcaaacactctatatcaagacccccctccccgagagctggttgttaaacatttgtcagcacaccactgctgctgggagacagagagaagaaactgatacacgtgagcactgaaacatcttagttccagggaggtagcatttgtgttgtatttctcagaagcaagtgtcctagtgtaatgtgcacaagtggcatgaagtttaacacctaaaagactgcttctctgcttgttctgtctaacttctgtgatttcaacacttgagaaagatgtttactttgctactaaacttattggagtgatttgtaaagttcactgtcacctgtgggcagtagttcagctaaattccctccaggaaagtggactgtagcttttcctgcctaactggcaaaatgaaaatatgctgaaaagaatacatcttaactaggcaccagaatagctcatttccaagtggtttatacagcaataacagtgttaacttctccaacagagacgaaatcatttataaatgattgttttgctgtttttgctttttattaaaattattactatggaa

SEQ ID NO: 176358 - DNA, 5830 bp, Homo sapiens
  Payload ID: 14624
  Gene Symbol: RIMKLB
  Gene Name: ribosomal modification protein rimK-like family member B
  Uniprot ID: Q9ULI2
  ENST ID: ENST00000357529
  CDS Start-End: 1263-2423
ggtctgagggagcggggcggtctccgccggcgtcgcgcgcgctgtgtgtgagcggggtcgcgcgcgcgcgcggcaggcgagtgagggaacgaggagcggccgggtgtgagtgtgtgggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgatctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcataaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacaggtaaccactgctgctactgtttttatttgtttgtttgttcaattttatttaagatttgtttttgttgtactaggattttaaaaaatgtaatatattgcaggatttataaccagg

SEQ ID NO: 176359 - DNA, 1589 bp, Homo sapiens
  Payload ID: 14624
  Gene Symbol: RIMKLB
  Gene Name: ribosomal modification protein rimK-like family member B
  Uniprot ID: Q9ULI2
  ENST ID: ENST00000544257
  CDS Start-End: 185-1108
atggattcgtgggctgcttccacctgctaggagggtggtgtactctaactcagggacagaagcccctgtctgtgctcaggactcttgcagacctctttacctggctgttcatcttccataatcaactggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgatctgctgatgaaagatgacggctccttctgcgtctgtgaggccaatgcaaatccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataacata

SEQ ID NO: 176360 - DNA, 481 bp, Homo sapiens
  Payload ID: 14624
  Gene Symbol: RIMKLB
  Gene Name: ribosomal modification protein rimK-like family member B
  ENST ID: ENST00000539923
  CDS Start-End: 197-481
cttttcgctccccgcgcgcgatccatcgcctctcttcccccgaggccagcgatggctcggccgcccggcggcccgcgcttcctcgaaggccccagcccggctcagtcggccgagagcgagggaggagccccccgacccaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatcta

SEQ ID NO: 176361 - DNA, 5392 bp, Homo sapiens
  Payload ID: 14624
  Gene Symbol: RIMKLB
  Gene Name: ribosomal modification protein rimK-like family member B
  Uniprot ID: Q9ULI2
  ENST ID: ENST00000538135
  CDS Start-End: 826-1986
ggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgatctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcataaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacaggtaaccactgctgctactgtttttatttgtttgtttgttcaattttatttaagatttgtttttgttgtactaggattttaaaaaatgtaatatattgcaggatttataaccag

SEQ ID NO: 176362 - DNA, 555 bp, Homo sapiens
  Payload ID: 14624
  Gene Symbol: RIMKLB
  Gene Name: ribosomal modification protein rimK-like family member B
  ENST ID: ENST00000541044
  CDS Start-End: 213-555
gtttacgccggtttctagggggcagagctggcgctatccaccccgcctgtatctccaaacccgcttcagccaggaaatttatcatgtggttttaaatttgcctctcaatatacagaggtactgtctttactccagtcccggataaagaccttctaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaata

SEQ ID NO: 176363 - DNA, 560 bp, Homo sapiens
  Payload ID: 14624
  Gene Symbol: RIMKLB
  Gene Name: ribosomal modification protein rimK-like family member B
  ENST ID: ENST00000537189
  CDS Start-End: 51-560
ttttcgctccccgcgcgcgatccatcgcctctcttcccccgaggccagcgatggctcgggtgcgggcgaggagctgggagggcggctctcgacgcagccgcccggcggcccgcgcttcctcgaaggccccagcccggctcagtcggccgagagcgagggaggagccccccgacccaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatc

SEQ ID NO: 176364 - DNA, 2236 bp, Homo sapiens
  Payload ID: 14624
  Gene Symbol: RIMKLB
  Gene Name: ribosomal modification protein rimK-like family member B
  Uniprot ID: Q9ULI2
  ENST ID: ENST00000535829
  CDS Start-End: 455-1615
agcaagcgggcgggcggcgttcggtctgagggagcggggcggtctccgccggcgtcgcgcgcgctgtgtgtgagcggggtcgcgcgcgcgcgcggcaggcgagtgagggaacgaggagcggccgggtgtgagtgtgtgggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgatctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcataaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaa

SEQ ID NO: 176365 - DNA, 1519 bp, Homo sapiens
  Payload ID: 14624
  Gene Symbol: RIMKLB
  Gene Name: ribosomal modification protein rimK-like family member B
  Uniprot ID: Q9ULI2
  ENST ID: ENST00000619374
  CDS Start-End: 125-1048
tgtatgaaatccagaaatcaagtagatttcttgatttaccttttatgtatattttttcttccatctaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgatctgctgatgaaagatgacggctccttctgcgtctgtgaggccaatgcaaatccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctgg

SEQ ID NO: 176366 - DNA, 2278 bp, Homo sapiens
  Payload ID: 14625
  Gene Symbol: RPL10
  Gene Name: ribosomal protein L10
  Uniprot ID: P27635
  ENST ID: ENST00000344746
  CDS Start-End: 149-793
agcgcctctttcccttcggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctatgtctttgtatctacattcttgacggggaaggaacttcctctgggaacctttgggtcattgccctttcacttcagaaacaggttgacaactcagccctgctcatgaggcagcaaaccctgcaaagggctgggactggtggccttatgtcagttgtctactctggagcttgacttggacctccccaggtcctaggcagtaggttgaaaaacactgaagtgcttttcatgaagcacagctgcagcaaagccttgcaatcccaggctggggtcagcctacagttgtgttgcttattacaacacatgcggaccaagaggggcttgtgggctagaggctgaccagcagcgtttatttagcaagggtaggtgtgcatcacattgggcttgttctcacccatctggtttggccattcctccttggtgggaatcatccaggtactgctgaggtcacctgcgatttgccccatttcctatctctagcaacctcctgggccccatgcccccaccccttctagaacctgcattcccagggccttcaccacctgaccaaaggtctaggctaacctttggtcatttgtaacaagacctcggaacagacacgtgtgtggcatggtttggcctggggatcttagatgtctgacctgaactattgtagaacagcgctggcttttgggggagcagcaaaaatgagaggagtgctaggtgggtggcctgagcatctgtatccagggacaggactccaaaggcttttggtcccagagctggggtatgttggccccagcccccagcctgtggctcccaaaaggcctctggttttttgtaatctcagtttacagccatttcttaggtttttaattacctttattttattttgccaaacatacctgggaataccttttattttttttttaccttggggtgatggttccaaaccataaatgtgattatagttaacacatgacccttctagcgtcccagccagtgtttttcctgacctctcttctttggagaggaggatggaagggaggggtccggcatgctgctggcattttgctgtgtcctgcagcccctttccgggacacctgggttcacacagctttttagcttacataactggtgcagattttctgtgtggagatgttgccttgaccagccttggctggactttaccaggcatgcagaagcctgtaccaacacagactacagcacccaggaggtgcgagtgtggctgctcagcggttataacaggcctgactgcattgttcaccggattataatgagccaaaatgtttcccggtgtttgctggtttcagggaaggagtttgatatagcagattaaccaccctccttgtagctattggggcttaatggtttcctggtgattcttaccaatccacaataaacatggcccattggcatatctgc

SEQ ID NO: 176367 - DNA, 1284 bp, Homo sapiens
  Payload ID: 14625
  Gene Symbol: RPL10
  Gene Name: ribosomal protein L10
  Uniprot ID: P27635
  ENST ID: ENST00000369817
  CDS Start-End: 577-1221
gcaattcctgacttgtactgccccagtggtgttacagcctcgaacccagtttccagacctaagtcaccgccggcatccagagtcccatgatggaaagggaggctaggttcccctgggaaggaccttgcaccactgctgcaagtgcaccccagaaatcgtcccaagcttttctcaaagggacctgcagccatttataaaagcgacatatcatcctggaaaacagaaatatacgtctgtcacagttaacggcaaagcctagggcaagagttctacgcccaagatggccagccggaagcgggcttctcgcgaccatgtggcgaagccccattcgtcagctggccgcccgcggccctggtacccggtcacctctctgatctgcgcatgtgctgggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaccta

SEQ ID NO: 176368 - DNA, 748 bp, Homo sapiens
  Payload ID: 14625
  Gene Symbol: RPL10
  Gene Name: ribosomal protein L10
  ENST ID: ENST00000406022
  CDS Start-End: 202-693
cgggaaaaacgggtgcggccgcctcctgtgtcctacagggggcgccagacgcatttccactcggcttggagttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctg

SEQ ID NO: 176369 - DNA, 657 bp, Homo sapiens
  Payload ID: 14625
  Gene Symbol: RPL10
  Gene Name: ribosomal protein L10
  ENST ID: ENST00000436473
  CDS Start-End: 56-657
ggaggagcgcctctttcccttcggtgtggtgaccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccc

SEQ ID NO: 176370 - DNA, 585 bp, Homo sapiens
  Payload ID: 14625
  Gene Symbol: RPL10
  Gene Name: ribosomal protein L10
  ENST ID: ENST00000458500
  CDS Start-End: 41-585
tctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaccta

SEQ ID NO: 176371 - DNA, 292 bp, Homo sapiens
  Payload ID: 14625
  Gene Symbol: RPL10
  Gene Name: ribosomal protein L10
  ENST ID: ENST00000428169
  CDS Start-End: 1-276
ctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagggggctcccatacctgctcagaccagcttgtcaccaagtctgcctcatccttaagtggatcgcgataccc

SEQ ID NO: 176372 - DNA, 457 bp, Homo sapiens
  Payload ID: 14625
  Gene Symbol: RPL10
  Gene Name: ribosomal protein L10
  ENST ID: ENST00000427682
  CDS Start-End: 1-396
ctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaaggcctaccttgctctgccagtgctgggagacctccagaaacacatcgtagagggcgttcagctccttctctacggccttaggagtggtgtgcagcgggaccaacaccaggctgggaaggactgcaaggcccagggaccgagggctgccatccactcctggaccttctccccctagcccgtctgggtgaggaagcccccagtggagccagccagaactccccttctgctcccacata

SEQ ID NO: 176373 - DNA, 713 bp, Homo sapiens
  Payload ID: 14625
  Gene Symbol: RPL10
  Gene Name: ribosomal protein L10
  ENST ID: ENST00000451365
  CDS Start-End: 1-327
ccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggcctaccttgctctgccagtgctgggagacctccagaaacacatcgtagagggcgttcagctccttctctacggccttaggagtggtgtgcagcgggaccaacaccaggctgggaaggactgcaaggcccagggaccgagggctgccatccactcctggaccttctccccctagcccgtctgggtgaggaagcccccagtggagccagccagaactccccttctgctcccacataccaagcccacccttcccttcctaccattgctgggcaaagagaactgggccacaaatggctcccgggcaaagacgtcatcctcatcgttgtacacgtaggaactcaggacctgtgttttgtgtgacctgggaggacaaagggatgggcagcagtggccccacgtctttgattttggcttgcaagtgccaaacggcgctcag

SEQ ID NO: 176374 - DNA, 622 bp, Homo sapiens
  Payload ID: 14625
  Gene Symbol: RPL10
  Gene Name: ribosomal protein L10
  ENST ID: ENST00000449494
  CDS Start-End: 1-87
ctccaccccttccacgtcatccgcatcaacaagatgttgtcctgtgctggggctgacagccccatcccttcacctcctcctcggtgagctggaagctcgtggggaagtcaaaggcagccgcagtgtgcagcagactccggcagcgctccccgtgcagcacgacgcggtcataggtgcagtgggtgctggcccgcactgtggtgtcctccccatcggcaatcacccagtggaagcctggctcagtccgcagctccagcttgtccaggcgctttttggtcagtgaagcgcagtcagcattgaagtccccaagcaggatcacgtcctagagacacagcagccatcaggctggccgctgggccaccctatccttgtccctcctgtacaaactgcccaggcctaccttgctctgccagtgctgggagacctccagaaacacatcgtagagggcgttcagctccttctctacggccttaggagtggtgtgcagcgggaccaacaccaggctgggaaggactgcaaggcccagggaccgagggctgccatccactcctggaccttctccccctagcccgtctgggtgaggaagcccccagtggagccagccagaactccccttctgctc

SEQ ID NO: 176375 - DNA, 2318 bp, Homo sapiens
  Payload ID: 14625
  Gene Symbol: RPL10
  Gene Name: ribosomal protein L10
  Uniprot ID: P27635
  ENST ID: ENST00000424325
  CDS Start-End: 189-833
gggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctatgtctttgtatctacattcttgacggggaaggaacttcctctgggaacctttgggtcattgccctttcacttcagaaacaggttgacaactcagccctgctcatgaggcagcaaaccctgcaaagggctgggactggtggccttatgtcagttgtctactctggagcttgacttggacctccccaggtcctaggcagtaggttgaaaaacactgaagtgcttttcatgaagcacagctgcagcaaagccttgcaatcccaggctggggtcagcctacagttgtgttgcttattacaacacatgcggaccaagaggggcttgtgggctagaggctgaccagcagcgtttatttagcaagggtaggtgtgcatcacattgggcttgttctcacccatctggtttggccattcctccttggtgggaatcatccaggtactgctgaggtcacctgcgatttgccccatttcctatctctagcaacctcctgggccccatgcccccaccccttctagaacctgcattcccagggccttcaccacctgaccaaaggtctaggctaacctttggtcatttgtaacaagacctcggaacagacacgtgtgtggcatggtttggcctggggatcttagatgtctgacctgaactattgtagaacagcgctggcttttgggggagcagcaaaaatgagaggagtgctaggtgggtggcctgagcatctgtatccagggacaggactccaaaggcttttggtcccagagctggggtatgttggccccagcccccagcctgtggctcccaaaaggcctctggttttttgtaatctcagtttacagccatttcttaggtttttaattacctttattttattttgccaaacatacctgggaataccttttattttttttttaccttggggtgatggttccaaaccataaatgtgattatagttaacacatgacccttctagcgtcccagccagtgtttttcctgacctctcttctttggagaggaggatggaagggaggggtccggcatgctgctggcattttgctgtgtcctgcagcccctttccgggacacctgggttcacacagctttttagcttacataactggtgcagattttctgtgtggagatgttgccttgaccagccttggctggactttaccaggcatgcagaagcctgtaccaacacagactacagcacccaggaggtgcgagtgtggctgctcagcggttataacaggcctgactgcattgttcaccggattataatgagccaaaatgtttcccggtgtttgctggtttcagggaaggagtttgatatagcagattaaccaccctccttgtagctattggggcttaatggtttcctggtgattcttaccaatccacaataaacatggcccattggcatatctgc

SEQ ID NO: 176376 - DNA, 2210 bp, Homo sapiens
  Payload ID: 14625
  Gene Symbol: RPL10
  Gene Name: ribosomal protein L10
  ENST ID: ENST00000618723
  CDS Start-End: 189-725
gggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtgccactgaagatcctggtgtcgccatgggccgccgccccgcccgttgttaccggtattgtaagaacaagccgtacccaaagtctcgcttctgccgaggtgtccctgccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctatgtctttgtatctacattcttgacggggaaggaacttcctctgggaacctttgggtcattgccctttcacttcagaaacaggttgacaactcagccctgctcatgaggcagcaaaccctgcaaagggctgggactggtggccttatgtcagttgtctactctggagcttgacttggacctccccaggtcctaggcagtaggttgaaaaacactgaagtgcttttcatgaagcacagctgcagcaaagccttgcaatcccaggctggggtcagcctacagttgtgttgcttattacaacacatgcggaccaagaggggcttgtgggctagaggctgaccagcagcgtttatttagcaagggtaggtgtgcatcacattgggcttgttctcacccatctggtttggccattcctccttggtgggaatcatccaggtactgctgaggtcacctgcgatttgccccatttcctatctctagcaacctcctgggccccatgcccccaccccttctagaacctgcattcccagggccttcaccacctgaccaaaggtctaggctaacctttggtcatttgtaacaagacctcggaacagacacgtgtgtggcatggtttggcctggggatcttagatgtctgacctgaactattgtagaacagcgctggcttttgggggagcagcaaaaatgagaggagtgctaggtgggtggcctgagcatctgtatccagggacaggactccaaaggcttttggtcccagagctggggtatgttggccccagcccccagcctgtggctcccaaaaggcctctggttttttgtaatctcagtttacagccatttcttaggtttttaattacctttattttattttgccaaacatacctgggaataccttttattttttttttaccttggggtgatggttccaaaccataaatgtgattatagttaacacatgacccttctagcgtcccagccagtgtttttcctgacctctcttctttggagaggaggatggaagggaggggtccggcatgctgctggcattttgctgtgtcctgcagcccctttccgggacacctgggttcacacagctttttagcttacataactggtgcagattttctgtgtggagatgttgccttgaccagccttggctggactttaccaggcatgcagaagcctgtaccaacacagactacagcacccaggaggtgcgagtgtggctgctcagcggttataacaggcctgactgcattgttcaccggattataatgagccaaaatgtttcccggtgtttgctggtttcagggaaggagtttgatatagcagattaaccaccctccttgtagctattggggcttaatggtttcctggtgattcttaccaatccacaataaacatggcccattggcatatctgc

SEQ ID NO: 176377 - DNA, 716 bp, Homo sapiens
  Payload ID: 14626
  Gene Symbol: RPL10A
  Gene Name: ribosomal protein L10a
  Uniprot ID: P62906
  ENST ID: ENST00000322203
  CDS Start-End: 28-681
tttccggttagcgcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttccctc

SEQ ID NO: 176378 - DNA, 812 bp, Homo sapiens
  Payload ID: 14627
  Gene Symbol: RPL10L
  Gene Name: ribosomal protein L10-like
  Uniprot ID: Q96L21
  ENST ID: ENST00000298283
  CDS Start-End: 86-730
gaggggcaacgtatataaatgcgcgcaggcgtagttaagagagcgcattttgacttcgaggcaccgccgacgttactgtgtcgccatggggcgccgtccagctcgctgttaccggtattgtaagaacaagccgtacccaaaatctcgtttctgccgaggggttcctgatgccaagatccgcatctttgacctgggtagaaagaaggcaaaagtggatgagttcccactcggtggccacatggtgtctgatgaatatgagcagctgtcttctgaagccctggaggccgcccgtatttgtgccaacaaatacatggtgaaaagttgtggcagagatggctttcacatgcgagtgcggctccatcccttccatgtcatccgcatcaacaagatgttgtcctgtgctggggctgacaggctccagacaggtatgcgaggtgcctttggaaaaccccagggtactgtagcccgggtccacattggtcaagtcatcatgtccatccgcaccaagcttcagaacgaggagcatgtgattgaagccttgcgcagggccaagttcaagttccctggacgccagaagattcatatctccaagaagtggggcttcacgaagtttaatgctgacgaatttgaagacatggtggccaagaagtgcctcatccctgatggttgtggagtcaagtacgttcccagtcatggccccttggacaagtggcgggttctgcactcatgaaggttttggcagtactgtctccttgggccatgctggtctgacttatgcttactaataaattctgtttactggcaaaaaataa

SEQ ID NO: 176379 - DNA, 634 bp, Homo sapiens
  Payload ID: 14628
  Gene Symbol: RPL11
  Gene Name: ribosomal protein L11
  Uniprot ID: P62913
  ENST ID: ENST00000374550
  CDS Start-End: 46-582
aaggccctcggccggaagctccgctttctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaatgtgcaa

SEQ ID NO: 176380 - DNA, 994 bp, Homo sapiens
  Payload ID: 14628
  Gene Symbol: RPL11
  Gene Name: ribosomal protein L11
  ENST ID: ENST00000443624
  CDS Start-End: 1-396
caggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtatgaatatttaatcttttcccgctcctggtctgtgaggagaggggaatctttatttcatatgtggtatgttggtgttcacatgttgagttgcagctttgaatattgtctgcctttgtgttctcctcccccttggggaaatgtgcctcatttgtggcaaatgtaggggtgcagctctgaacaaggtggacaagatccctgctgttggggaacttgcagtcgaggatctgtaaagcacccacatggcttaaaggtggatgaaggaaactgttccctccagccagtgatttgaaactttggagagaggcagtattggtgccacatttggcctatgggttggttggctgcactgaggctgttctccccctggttcttcctatagaaacagctttgggtgatgcagtggtttgctcaggaagggggttttaacatagaaatgaccttttgtgttactgccgtgttttggtccaacaataaaactgaatagcctaaatcagaagtcctgactagtgtggaacctgaaagatggtggcaccctcattagacagacaagtaataagacttggatactcacaggatgttggaggaacagcacacctttggg

SEQ ID NO: 176381 - DNA, 721 bp, Homo sapiens
  Payload ID: 14628
  Gene Symbol: RPL11
  Gene Name: ribosomal protein L11
  ENST ID: ENST00000458455
  CDS Start-End: 1-525
caggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaaggtaaagctgatttatctcaagtgaagtggtggaatgtgatgttggtgaatggagttgggatttggggatgcaaaatatagtactatttgctgggtatcttctttaaagttagaatattgggcatcttgacaaatcaggggcttccagggatgatggtttaaaagaacatccagaactaggccttctccctgtcaccatgaatgggggtagatggaagggg

SEQ ID NO: 176382 - DNA, 633 bp, Homo sapiens
  Payload ID: 14629
  Gene Symbol: RPL12
  Gene Name: ribosomal protein L12
  Uniprot ID: P30050
  ENST ID: ENST00000361436
  CDS Start-End: 89-586
ctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 176383 - DNA, 499 bp, Homo sapiens
  Payload ID: 14629
  Gene Symbol: RPL12
  Gene Name: ribosomal protein L12
  Uniprot ID: P30050
  ENST ID: ENST00000536368
  CDS Start-End: 57-455
gcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggt

SEQ ID NO: 176384 - DNA, 4498 bp, Homo sapiens
  Payload ID: 14630
  Gene Symbol: RPL13
  Gene Name: ribosomal protein L13
  Uniprot ID: P26373
  ENST ID: ENST00000311528
  CDS Start-End: 77-712
ccagagtgcattgcggggccgcttcctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtgacacacgcctgtaatcccagctacttggtaggcttgaacccaggaggcagagattgcagtgagccgagctgcaccactgtgctccagcctgggtgacagcgagactcagtctcaaaaaaagttgtacaaggtggatggttggaagcttgagcctaggctcgaatccctctcacgtgagagggcctgaagatttctggtggattccaacctggctgaagactggccgtggggggtgcaggggtctccagcgctctgccctccagcctgcttcctccctgcccacaccgcactaggggaagggcctttcctgctgcctgcggggccgcacctggagtaggtaatgccatgtggtgacgtgaatggagcagaggtctgtgccccatcacaccgccttgctgtttttactgtgggacaaaagcactctgatctgcgtgttccgggggccctcctaccagccgacttgacgggaagtcagggttcaggtatcatctgtgcacctggggcggggtagtctgcactgaacctgccagagtcccctcctcatttcactgaaagtcacagtctccagggctgtgttgctaaccttacgttctctccgtttgcttaatctattaagagccctaacaggagaggatgggctttctctgttgtctggggccctgctgttggccggtgctcttagcaagaggtcatttttctaggttgcgctgggacattgtgagtttggtgagggtcatggatgtgggctgggctgggctgggctgggccgggctgcctgctgcctgctgctcccctacctgaaatgcagctagtgcggctctgcccttcctggggctgaggaaggcttctgcaggatagctggggggctgggcaggtgggtgaggcagcctccctgctgacactcagtccttgtagctggagcaagatctcctgatccaggtacgggcctgtctgctccaagaaagactctgccaccagatgcaaaggggccctttgttttaacttagtccctggggaccgcctgattcagcacctgtcggcccaggataccccgctggtggggacaagtgcctgagtgtgggccgtgcccgagtgtggccatccctgagtggggccgtcctgactaggaagtggcttttcagttgtgatgtgtgggcctgacctagggggcgctgtggaacccgggctggaaccagccctctgtgccaggccgcagacaggttccgccggccctgaggggcagctgccatggcgtgggtcactgggagctgagaggaagggcccccaccgcacctcaggcaaagcggctctgggaacaccttgatttcgtccatgtgagccgtcccagggagggcagccaagctgtgaagcctgagaaactgacctgtgtgccacgagcttgtggtctgctgcccggtggaggaagtgcaggtgcgcccaggctcctcattccgttttgcaggattccttcggggtgtgagcatttcctattcagcctgtcgcccccggggagcacgggctggctctgtggtgcccgtggccttttgtagaagcgttggttttacggcaggttcatctctggggcagcctcccacagtgggtggggctttgccagcagtgcccacgggggtcatggggccaggcgcgctccggcgcctgcagaactgatcggggatagtctcaggaggcgctagtcacgtgccccggtgatcggggatagtctcagaaggcgctagtctcctgccccggtgatcggggatagtctcaggaggcacgagtcgcctgcctcggtgatgcaccgtttctcacaccggctgctctggcccgagctaaaggggaagacgtgtgcggataggagctgcacacaattttcctccatgtattgtttattttgctttttcttttggctagacattaggaatttcagttttcccaagttgtatttttccttttctattttaaaattatcatgcagggctgggtgaggtcgctcacgcctatagtctcaaaactttgggaggctgaggggggaggatggcatgagcccaggagtttaaggctgcagtgagccgagatcgctccactgtcctccagcctgcatgacagagcgagaccctatctcaggaaaaaaaaaaacaaaactattatgcagtagtttcgaccctggaagacgagtgtgcatctttgagttgtaacacgtgtacctcgcccatccaggcgtagtttcatttggaatctggttatcctgtagttgctttgttaaaaatatatgtaattgcaaatcatt

SEQ ID NO: 176385 - DNA, 2385 bp, Homo sapiens
  Payload ID: 14630
  Gene Symbol: RPL13
  Gene Name: ribosomal protein L13
  Uniprot ID: P26373
  ENST ID: ENST00000393099
  CDS Start-End: 250-885
aggtgagggagactgggtcctggcctttgggcatcatccagcgccatcggcctggcgcttcagccaacgcgggagtggatgggccccttcttcttcgcagacagcgttcggccgctgcccgggctctaggcgcggccggacggcccagtctggagggttcggggcggaggcccgggggggtgcgcgcgcccggggtccggcctctcactcgctcccctctcgtccgcagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtga

SEQ ID NO: 176386 - DNA, 1455 bp, Homo sapiens
  Payload ID: 14630
  Gene Symbol: RPL13
  Gene Name: ribosomal protein L13
  Uniprot ID: P26373
  ENST ID: ENST00000452368
  CDS Start-End: 51-545
tttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcat

SEQ ID NO: 176387 - DNA, 712 bp, Homo sapiens
  Payload ID: 14630
  Gene Symbol: RPL13
  Gene Name: ribosomal protein L13
  Uniprot ID: P26373
  ENST ID: ENST00000567815
  CDS Start-End: 39-674
cctttccgctcggctgttttcctgcgcaggaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgc

SEQ ID NO: 176388 - DNA, 958 bp, Homo sapiens
  Payload ID: 14630
  Gene Symbol: RPL13
  Gene Name: ribosomal protein L13
  ENST ID: ENST00000562879
  CDS Start-End: 52-243
ctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctg

SEQ ID NO: 176389 - DNA, 554 bp, Homo sapiens
  Payload ID: 14630
  Gene Symbol: RPL13
  Gene Name: ribosomal protein L13
  ENST ID: ENST00000563270
  CDS Start-End: 391-554
cctttccgctcggctgttttcctgcgcaggagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaa

SEQ ID NO: 176390 - DNA, 631 bp, Homo sapiens
  Payload ID: 14630
  Gene Symbol: RPL13
  Gene Name: ribosomal protein L13
  ENST ID: ENST00000472354
  CDS Start-End: 1-235
accggtcatgcccgtccggaacgtaagtgaacacttactcaaatccaggcttcagacgagatcagtgggtgaacacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagcca

SEQ ID NO: 176391 - DNA, 528 bp, Homo sapiens
  Payload ID: 14630
  Gene Symbol: RPL13
  Gene Name: ribosomal protein L13
  ENST ID: ENST00000467736
  CDS Start-End: 150-528
aggtgagggagactgggtcctggcctttgggcatcatccagcgccatcggcctggcgcttcagccaacgcgggagtggatgggccccttcttcttcgcagacagcgttcggccgctgcccgggctctagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctct

SEQ ID NO: 176392 - DNA, 1181 bp, Homo sapiens
  Payload ID: 14631
  Gene Symbol: RPL13A
  Gene Name: ribosomal protein L13a
  Uniprot ID: P40429
  ENST ID: ENST00000391857
  CDS Start-End: 77-688
cacttctgccgcccctgtttcaagggataagaaaccctgcgacaaaacctcctccttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaa

SEQ ID NO: 176393 - DNA, 660 bp, Homo sapiens
  Payload ID: 14631
  Gene Symbol: RPL13A
  Gene Name: ribosomal protein L13a
  ENST ID: ENST00000467825
  CDS Start-End: 1-632
cggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtgagcagagcgtggggactgcaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatg

SEQ ID NO: 176394 - DNA, 794 bp, Homo sapiens
  Payload ID: 14631
  Gene Symbol: RPL13A
  Gene Name: ribosomal protein L13a
  ENST ID: ENST00000484279
  CDS Start-End: 23-163
cttttccaagcggctgccgaagatggcggaggtgcaggtcctggtgcttgatggtcgaggccatctcctgggccgcctggcggccatcgtggctaaacaggtactgctgggtaagtcgctgctcgtggcccctctgtcatgggcccccgctggaggtcagtgatgagcaacattcaccatctttcgtttgagtctcacggccatgagatcaaccccatgcaccgctctgagacctgccagccactcttccccagggttggggactccaggctcaagaagccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcc

SEQ ID NO: 176395 - DNA, 1098 bp, Homo sapiens
  Payload ID: 14631
  Gene Symbol: RPL13A
  Gene Name: ribosomal protein L13a
  ENST ID: ENST00000621674
  CDS Start-End: 184-612
cacttctgccgcccctgtttcaagggataagaaaccctgcgacaaaacctcctccttttccaagcggctgccgaagatggcggaggtgcaggtcctggtgcttgatggtcgaggccatctcctgggccgcctggcggccatcgtggctaaacagtgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgctttt

SEQ ID NO: 176396 - DNA, 1122 bp, Homo sapiens
  Payload ID: 14631
  Gene Symbol: RPL13A
  Gene Name: ribosomal protein L13a
  ENST ID: ENST00000624069
  CDS Start-End: 28-174
tcctccttttccaagcggctgccgaagatggcggaggtgcaggtcctggtgcttgatggtcgaggccatctcctgggccgcctggcggccatcgtggctaaacaggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaa

SEQ ID NO: 176397 - DNA, 7072 bp, Homo sapiens
  Payload ID: 14632
  Gene Symbol: RPL14
  Gene Name: ribosomal protein L14
  Uniprot ID: P50914
  ENST ID: ENST00000338970
  CDS Start-End: 70-717
ggcggtgcgttcttctacacatgcgcagggttgggcgggtcttcttccttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctggagttaggaggcagattgatagtaggattataataaacattaaataatcagttcctttttttttttttttttttttgagatggagtctcgttctgttgctcaggccggactgcagtggcgctatctcggctcactgtaagttccacctcccgggttcatgccattctcctgcctcagcctcctgagcagctgggactacaggtgcccgccaccgcgcctggctaattttttgtatttttagtagagacggggtttcaccgtgttagccaggatggtctcgctctcctgacctcgtgatccgcccgcctcggcctcccaaagtgctaggattgcaggcatgagccgccgcgcctggcctaaataatcagttctttaatctcactctctgcccatacttggataggtagtgcaaaatcattgcagtcataattgatcatgtcatgagaaatcatgataacttagaacaccaagtgacacaagtgacatttttttcttatggtcaccttggcttcagaacatcttttttccttgtacaaatatgtttgccataaataggtaaagtgacagcctcttgatgctcaagagtctagcagatttattttatttatttattttttttttttggagacagagtcttgctgtgttgcccaggctggagtgcagtggtgcgatctcagctccctccaccttccgggttcaagtgattctcctgccttggcttcccaggtagctgggactacaggcgcccaccaccatgcccagctaattttttttgtagagactgggtttcactatgttggccaggctggttttgaactcctgacctcgtgatccgcctgtctcggcctcccagagcgggggattataggcatgggccactgcacttggcctttttttgtttttttgagacagagtcttgatcttatcacccaggctggagtgcagtggcacgatcttggctcagcgcaacctctgcctcctgggctcaagcggttctcctgctcagccttctgagtagttgggactataggtgtgtgccaccacgtctggctagtttttgtatttttagtggagatggggtttcaccatgttggccatgctggtctcgagctcctgacctcaggtgatacacccgccttggcctcccaaagtgctggaattacaggtgtgagccactgtgcccggcctgcaaattttcttataaaaagtaaactaggaaaatagggcaagtataaaaattgcaggttgagcatatttctaatccaaaaagctctaacctctgaaactgagctatgacactacaatttaaaaatccctagcctacccgcatggtgggttatggtcaaaatacaggtacacagcactattcagtgtccctgaggaagaaatagttaaccttcagggtacatgtatatgaagcataaatgaatttcctgtatagacctaggtcccatccccaaagtgtcatgtatatgcacttaactccaacatcagaacacatctcgtcctaagtgtttcagataagagatacttatcctgtgtatagtaggttggacttctgtttctctctaccacaagatacaggtaatttggggcagtaaaagatcctggatagatttaaaaatactacaaagctgtacatgaaacaggattacttttttttttttttttgagacagagccttactcttgcccaggctggaatgtagtggcacgatctcagctcactgcgacctccacctcccaggttcaagttgttctgcctcagcctcccaagtagcaggggttaaatgcgtgtaccaccatgcccctctaatattgtattagagatggggttttgccatgtcagccagactggtcttgaactcctgacctcaggtgatctgtccgccttggcctcccaaagtgctgggattacaggcgtgagccaccgcttctggccaggaatacattttaaataaatttgtttcctaaccaaaagctagcttcaggcgtcactggggtaaaggaaaaagcacattgatttgcttgataataggcaagtggtatggtgtaataaggaaaatatggatgatttcggattacctgttctactctgggaggtagagaattgtctagagaaagtggcatctatacctaaaataagaagaaggtggtgtaaggggaagaatgacacgagataggaaataaacgaactgatagtgtagaggactggctcgggaccacatcaaggaagtaggttagtggttagatcgtgtaggggaacacgggaagctactgagggttttttaaaatggcgtgatatctcagatttagatcattgaactgttaagactgaatcttatgggatcaagactgggaatgctcgggttggcagtatgaagtttggcagtaatccaaggaagtgacagtggtaatgccatttaggtggtcttgatcatgcattggactgcagaaataagggagaaaacaatgtgtcagggtttctggtttgtacctctggttcattggttgtgagggaacatgaggcagggtaaagtttatctaggtaaaatgagttagttttcatgtagactatctgggtgtatatgcaaagactgcagacaatctatactaaaatcctggctctgcctcttgaaagctatgtagtttaggcacatagtcaaaatccagtttcctcatctatgtggtacgcttcagagtagttaatcatgatatgtagtccagtgactggttcccttggtaagagctgtgataatgacacaaggaggagaggtttcaggacagacttgggattcatgaatatgtaagtggtcactgattccccaggggtaggatgacaacaatcaagagacgaatagaggttggaaaggagtcatgaggggtgggaaactagcaggggcacatggaagctagggaaagaattttgcttgagatcgtcaaagtgaggggaagagggtagtaagcaaaggagaaatgttatatggggttcggaggttttgtgtttgtaaatctggagtgatgggcatgttcaaatgcttctgggaaaggagctaataggagagaaacttagcccttcgaaaaacaggaagggatggatcctaggggagaggaggaaggattggctttagaggaaagatgtcctttacgtgaggaaaaggaagaaaaggtgggtttagatactaaatctgtaggtttgctgttaggaaattaaggacttttcacctttatctctgaaatttctctggagttagcaaggcaaggtcatacactgagaaggagggatgaggcagtgtagatttgcagacatacaggttgtaattccttatggaggaaaggggagagcacttttgtcagactgcctgtggctttgagagccctttggctacagtccatgaggtgctcagaggatgagaaagcttcagggtagaagcagtattcaagctgcacctagaaaacagtgcaatacagaacagtggaaattggaaattccaatcttggaatctctaggaaagtaactgaggcatacgatgcctgaaaaggagtagaaaataaaattaataaggtgggaccatatgataagagatttgaggccgggcactgtggctcacacctgtaatcccagcactatgggaggctgaggcaggcggatcacctgaggtcaggggtccgagaccagcttggccaacatggtgaaaccccgtctttactaaaaatacaaaaattagacaggcatggtggagcatgcctgtaatcccagctacttgggaggctgaggcgggagaatcgcttgaacccaggaggtggaggttgcagtgagctgacattacgccatagcactccagcttgggcgacagagggagactctgtctcaaaaaaaagacttgagcaagggcgtaatcttcaggaaggtcagtctggtagcatagtgtggattgggttgggggatggggaaggagagcagaaaattattgaaatatccaggtgcataaaagtctactttgattatggagaactacacacttgttcagtcaccctcattggagacgggggatggcatacgaaaagaatgctgatttcaggctgggcacggtggctcatgcctttaatcccagcactttgggaggctgaggcaggtgaatcaggggttcaagaccagcctggccaatgtggtgaaaccctgtctctactaaaaatcaaaaaaaaaaaaaaaaaaatggctgatttcagagtcatattcaggtttaaattctgtcattcagcccaaactcattactttatgttacttatgggaacctcatctaaaaagcaaggatcctgatacctgcctcatattgtggcaaggatcaaatgagtcaaataagatgcttgtgaaagtgaggacaggatctatcctcaacacctagtgcaattctttttacacattaggtacttagtaatttgggttgaattgtgttgaactaacctggcggtataggcaaaatttggaagtttggttttcagaaagtcttgacttcctcttatctctaagtaattggcatgtcctctaattcatattttcccccctcatctgttgggtgaaatactgtttatcctttagtactaaaattaaaagttacctcattcttctagctagctgatttttttttttaatctaggctaaatcatgaatacatttacatttaaataaaatattacagttgaaagtaaagggtcctttcattatctccacttccaattccagtaccctgtgtaaaggaaaacatatacatcttgcagacattttttaatgtgtttgtaatataggtacataaaaatatatgtgcttgttttaagcaaatttcatactctgcaacttgccttttttcttaatacgttctggagatcttatctagtcagcctctaaattagagttcttcagaaaaccaatgggatggatgaatggactcaagagattgtggaaaccaagaagtcccacaaaataccatctgcaagctggagaaccaggaaagctgattgggataattcaaactgggtccagaggcctgagaactggaagggccagtggtgtaagtcctggtctgagaccaaaggcttgatcaagaatcaagagcatcaacaaccgagggcaggagaggatgggtttcccagattaaaaaagcaaattcacgcttcctcccccattttgttctatttgaaccttccgtggataggatgatgcccacctgcattggtgaaggtcatctttactcagtctacccattcaaatgccaatctcttccagaggtaatctcacagatttagaaatgtttcgccagctagctgaacaatccttagcccagtcaagtgcacacataaccataacaattcttactaatctacctcattcttttttatcttctgcataataatccacaacatgaatgttcacgtttgacctctattgatagacatttcggatgatgccaatttctttttctggtttttgttttttgtgtgtgtgtgttttttttttttttgagacgaggtcttgctctcgcccaggctggagtgcagtgggtggggtgatctcggctcactgcaacctctgcctcccgggttcaagcagttctcctgcctcaacctcctgagtagctgggattacaggagtgtgccaccacacctggctaatgtttgtattgttagtagatacagggtttcaccctgttagccaggatggtggatgggcatttgaatgggtagactgagtgatcctgacctcgtgatccactccccagtctcccaaagtactgggattacaggcgtgagccacggcaccaggccctctttttctatttaaacagtgcttccgtgaatgtccttgtgtacacctccttctgtacacaatgatgtttatctgatgcacattgccaatcagtgcacttgctggattgaagaatgtgagtgtttgtatcactctttcagtaggctgtaccaatttagacttgctctaccaatttagatttccatcagcagtaaacaaagacattcctgcctggcagtcttgaactcctgctattatctcttaaatttttgccagtgtgtgaaaagtagtatcttactttaacttgtattttcctggtccaatagtgcactaaatgcccgagttctgtatttattctatttggatagccattagatagccattaagtccactcatagagttattttaaatgttttcctttagtttccaaccacattttcaaataaaatttagaattagcttgtcaa

SEQ ID NO: 176398 - DNA, 916 bp, Homo sapiens
  Payload ID: 14632
  Gene Symbol: RPL14
  Gene Name: ribosomal protein L14
  Uniprot ID: P50914
  ENST ID: ENST00000396203
  CDS Start-End: 133-780
ttctcgcctaacgccgccaacatggtgagtcttactgttgcgggctccggggccgtcgaccatgccgctcgacctccacctccgctgggaagctgaggcgccaaacggctcccagagggtcccgggaagcgcatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctggagttaggaggcagattgatagtaggattataataaacattaaataatca

SEQ ID NO: 176399 - DNA, 812 bp, Homo sapiens
  Payload ID: 14632
  Gene Symbol: RPL14
  Gene Name: ribosomal protein L14
  ENST ID: ENST00000416518
  CDS Start-End: 119-493
cgccaacatggtgagtcttactgttgcgggctccggggccgtcgaccatgccgctcgacctccacctccgctgggaagctgaggcgccaaacggctcccagagggtcccgggaagcgcatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaa

SEQ ID NO: 176400 - DNA, 966 bp, Homo sapiens
  Payload ID: 14632
  Gene Symbol: RPL14
  Gene Name: ribosomal protein L14
  ENST ID: ENST00000435633
  CDS Start-End: 110-268
ggtgagtcttactgttgcgggctccggggccgtcgaccatgccgctcgacctccacctccgctgggaagctgaggcgccaaacggctcccagagggtcccgggaagcgcatggtgagggtccccgggccggctgtgcagcggaatcgggcccttcccggactcgcgcccttcccggactcgccgctggcgagcgcgtggagggcccggcaggcctggcgcgccttgggccacgcgtgcgcgcctccgccgctggagctggatggctgatgcggctcgtggtccgagagccttgtcctgccgtgtgggccttgcggacctgggagctggcgggcgttgggaaccgggcttaagctactgaggcgtttgctgatttcgtccatccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctca

SEQ ID NO: 176401 - DNA, 2730 bp, Homo sapiens
  Payload ID: 14633
  Gene Symbol: RPL15
  Gene Name: ribosomal protein L15
  Uniprot ID: P61313
  ENST ID: ENST00000307839
  CDS Start-End: 640-1254
tggaggagcttcacgcagtctggagctgaagggacacagcgagcgccccgacccgcgacgccccgactccgcgaaggcctccctgggaggctggggaagcgtcgggggatctctcagcgcagctctggggcccagatttctgcgcccgtcgtgcggtggccagagagggacagcgcagcgcggagacgcggagacgcagagactccgcagggggagagcccgcggtgcgtgaaacaaacctgttctctcctcagacctcaaagacagcggctccaccgcggtacgcggccaccggctttggagcctggaccccaacttgcctcctctcgcggagagacagtcgccgacgctcgcttagccgccgagacctcgccgccaactctctcacctctcgagacgcccaggccgctcaggctcgaatcttgcggagcagggggcgggacaatagcggccgcggcgccccactcggcagaactccgccaccaggcgcgatgccggaactacatgtcccatgacgctctgggaggccgcagctttccaccggaaagagggtggctgaggtgggggaggagcccaaaaggcattgtgggagtacagctctttcctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaaggaataaatgtctattaaactaaaacaaatggaccttctgttattttttgtcatcttacagtgctaatgtactttaaagcaaaccaaatgccctaaccagcaaaaaggcatcaaaatgtgattatagaaataatataatttgagatagcataaaatgta

SEQ ID NO: 176402 - DNA, 820 bp, Homo sapiens
  Payload ID: 14633
  Gene Symbol: RPL15
  Gene Name: ribosomal protein L15
  Uniprot ID: P61313
  ENST ID: ENST00000354811
  CDS Start-End: 156-770
gggctagctgtccccggcagttggtgcagagccattttcattcccggcggtttccttgtttttgttggggaactaagatggacggatacagtcgtcttattgtacttaaagcggatgatatttaatacacagtttgatttcacaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtc

SEQ ID NO: 176403 - DNA, 588 bp, Homo sapiens
  Payload ID: 14633
  Gene Symbol: RPL15
  Gene Name: ribosomal protein L15
  ENST ID: ENST00000422218
  CDS Start-End: 189-588
cccgacccgcgacgccccgactccgcgaaggcctccctgggaggctggggaagcgtcgggggatctctcagcgcagctctggggcccagatttctgcgcccgtcgtgcggtggccagagagggacagcgcagcgcggagacgcggagacgcagagactccgcagggggagagcccgcggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcc

SEQ ID NO: 176404 - DNA, 830 bp, Homo sapiens
  Payload ID: 14633
  Gene Symbol: RPL15
  Gene Name: ribosomal protein L15
  Uniprot ID: P61313
  ENST ID: ENST00000415719
  CDS Start-End: 170-784
cctttccgtctggcggcagccatcagcggcatctcctttcaggtcctccttggggacgccgcctgccgcagccacccgcccccttggtgctcagttctggttctgttaattcgccccaccaaaacgtgccgagcaccgctctgtgctggggttgcggaagtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggac

SEQ ID NO: 176405 - DNA, 1063 bp, Homo sapiens
  Payload ID: 14633
  Gene Symbol: RPL15
  Gene Name: ribosomal protein L15
  Uniprot ID: P61313
  ENST ID: ENST00000435882
  CDS Start-End: 159-773
cctttccgtctggcggcagccatcaggtaggctgcgttgaggatctttgctcttccatccgcctttgatcgtcttcctcttcagccatccaggtccggggaccctgcgtcctcggagataggtctccctcctgtgcggccagagtttggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaa

SEQ ID NO: 176406 - DNA, 2835 bp, Homo sapiens
  Payload ID: 14633
  Gene Symbol: RPL15
  Gene Name: ribosomal protein L15
  Uniprot ID: P61313
  ENST ID: ENST00000456530
  CDS Start-End: 381-818
aaagacagcggctccaccgcggtacgcggccaccggctttggagcctggaccccaacttgcctcctctcgcggagagacagtcgccgacgctcgcttagccgccgagacctcgccgccaactctctcacctctcgagacgcccaggccgctcaggctcgaatcttgcggagcagggggcgggacaatagcggccgcggcgccccactcggcagaactccgccaccaggcgcgatgccggaactacatgtcccatgacgctctgggaggccgcagctttccaccggaaagagggtggctgaggtgggggaggagcccaaaaggcattgtgggagtacagctctttcctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactggatggagtctcactctcactcaggtgggagtgcagtggggcaatcacggctcactgcaacctctgtctcccgggtttgagcaattcttctgcctcggcctcccaaatagccaggactacaggcgcacactgccatgcccagctaagttttgtatttttagtagagactgggtttcactatgttggccaggctggtctcgaactcctgacctcaagtgatccacctgccttggcctcccaaagtgctgggattacaggcgtgagccaccacccccagcccaatttttattttttgtacagacaggatctcactatgttgcccaggttggtctcaaactactggcctcaagcaatcctgccttggcctcccaaagtgctggaattataggaatgagccaccacaccgggcccaaatttactttagtaataacaacaattggctgggtgcggtggctcacgcctgcaatcccaacactttcggtaaccaaggtgggcttgagctcatgagttagagagcagcctgagcaacgtggtgagagcccatctcacaaaaaataacaaatcagctgggcatggtgttgcacgcctgtagtctccgaaatcacaccactgcactcccatcttgggtgatagagccagaacttgtctcaaaaataacaattggtttcttacaatcccaaaaggtgcagttactagtattaatccttttttgccaatgaggaaacacaaagatgaagcaacttgctcaaagtcatacagtgacagtctgaattcaaatcctatacacttaaagtttatttgttttgttttggttttttttgagatggagtctcactgtgtcgcaaggctggagtgcagtggcacgatctcagctcactgcaacccgggttcaagcgattctcctgcctcagcctcccgagtagctgggactacaggcacgcaccaccacacccagctaatttttgtatttttagtagagacggtttcaccatgttggccaggatggtctcgagctcctgacctcaggtgatcctcccgccttggcctcccaaagtgccgggattacaggtgtcagccactgcacgtggccaacttaaagtttttgatagataatacattaacgttaaaaattcaaaagataagtataggctctacagtacaaacccttctgcctcctagttcctctccctggaggcaaggtgatcagtttaacaatatttttttattttgagacagggtctcactgttgcccaggctggagtgtagtggcgcgttcacaacttactgtagcctcaacctcctggctcaagcaatcctcccacctcagcctgtcgagtagctggaaccacaggtgcacaccaccatgccaggctaatttttgtattttttgtagagacagggtttcaccatgttgttcaggctggtctcaaagtcctgggctcaagcaatcttcctgtctctgcttcccaaagtgctgggattacagatgtgggccacggtgcctggcctacatatgtattttttccttttcttccccaagtggtaggatatgatacacattgttgatttttttgtttagttatgtatctcagagcttattctttatcagctcatgaggaacttcatttttttttttttttttgagatgtagttttgctcttatagcccaggttggagtacagtaacacaatcttggctcgcagcaacttctgcctcccaggttcaagcgattctcctgcctcagcctccgagtagctaggattacaggtgcctgccactacatccagctatttttgtattttcagtagagacggggtttcaccattttggccaagctggtctcgaactcctgacctcaggtgatccgcccatctcagcctcccaaagtagtgggattacaggcatgagcaaccgtgcccggctggaacttcattcttttggtataactgcatggtatcccatcatgtggatgtaccatgattcattggatgtggaccctcctgatggacatttaaatttcttccaatctgttgctattacaaaaagaaaaatgtgtgcatacatctttattcatctgtagaataaattcttagaagt

SEQ ID NO: 176407 - DNA, 650 bp, Homo sapiens
  Payload ID: 14633
  Gene Symbol: RPL15
  Gene Name: ribosomal protein L15
  ENST ID: ENST00000434031
  CDS Start-End: 128-650
gggcgggacaatagcggccgcggcgccccactcggcagaactccgccaccaggcgcgatgccggaactacatgtcccatgacgctctgggaggccgcagctttccaccggaaagagggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttg

SEQ ID NO: 176408 - DNA, 1990 bp, Homo sapiens
  Payload ID: 14633
  Gene Symbol: RPL15
  Gene Name: ribosomal protein L15
  ENST ID: ENST00000436146
  CDS Start-End: 14-193
caggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggtacgtgatcgactgcgttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaaggaataaatgtctattaaactaaaacaaa

SEQ ID NO: 176409 - DNA, 562 bp, Homo sapiens
  Payload ID: 14633
  Gene Symbol: RPL15
  Gene Name: ribosomal protein L15
  ENST ID: ENST00000412097
  CDS Start-End: 38-562
tcctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggtaaatgctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttgga

SEQ ID NO: 176410 - DNA, 2053 bp, Homo sapiens
  Payload ID: 14633
  Gene Symbol: RPL15
  Gene Name: ribosomal protein L15
  Uniprot ID: P61313
  ENST ID: ENST00000413699
  CDS Start-End: 120-734
tgggagtacagctctttcctttccgtctggcggcagccatcaggtaggctgcgttgaggatctttgctcttccatccgcctttgatcgtcttcctcttcagccatccaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaagg

SEQ ID NO: 176411 - DNA, 2363 bp, Homo sapiens
  Payload ID: 14633
  Gene Symbol: RPL15
  Gene Name: ribosomal protein L15
  Uniprot ID: P61313
  ENST ID: ENST00000611050
  CDS Start-End: 394-1008
aaagacagcggctccaccgcggtacgcggccaccggctttggagcctggaccccaacttgcctcctctcgcggagagacagtcgccgacgctcgcttagccgccgagacctcgccgccaactctctcacctctcgagacgcccaggccgctcaggctcgaatcttgcggagcagggggcgggacaatagcggccgcggcgccccactcggcagaactccgccaccaggcgcgatgccggaactacatgtcccatgacgctctgggaggccgcagctttccaccggaaagagggtggctgaggtgggggaggagcccaaaaggcattgtgggagtacagctctttcctttccgtctggcggcagccatcagtttgatttcacaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaaggaataaatgtctattaaactaaaacaaatggaccttc

SEQ ID NO: 176412 - DNA, 827 bp, Homo sapiens
  Payload ID: 14634
  Gene Symbol: RPL17
  Gene Name: ribosomal protein L17
  ENST ID: ENST00000580387
  CDS Start-End: 439-827
cgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtcagtcggcctctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggaccta

SEQ ID NO: 176413 - DNA, 790 bp, Homo sapiens
  Payload ID: 14634
  Gene Symbol: RPL17
  Gene Name: ribosomal protein L17
  Uniprot ID: P18621
  ENST ID: ENST00000579248
  CDS Start-End: 201-755
ctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtcagtcggcctctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaa

SEQ ID NO: 176414 - DNA, 758 bp, Homo sapiens
  Payload ID: 14634
  Gene Symbol: RPL17
  Gene Name: ribosomal protein L17
  ENST ID: ENST00000583637
  CDS Start-End: 237-758
tggcttcgggggcgccggcctccaggcccccgggaggagaactcctagggctactaaatcctcgctggaggcggtggcttcttatgcgggaggacgtggcggagggcctgactttgggagccgggggttgactggattggtgaggcccgtgtggctacttctgtggaagcagtgctgtagttactggaagataaaagggaaagcaagcccttggtgggggaaagtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaa

SEQ ID NO: 176415 - DNA, 669 bp, Homo sapiens
  Payload ID: 14634
  Gene Symbol: RPL17
  Gene Name: ribosomal protein L17
  Uniprot ID: P18621
  ENST ID: ENST00000580261
  CDS Start-End: 80-634
agaagtcaagttctcatgagttctcccaaaatccaccgctcttcctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaa

SEQ ID NO: 176416 - DNA, 481 bp, Homo sapiens
  Payload ID: 14634
  Gene Symbol: RPL17
  Gene Name: ribosomal protein L17
  ENST ID: ENST00000578528
  CDS Start-End: 314-481
gggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtcagtcggcctctgaggtccgcagagggacgtgatgggcgggaatggggactaccgggctcctccactggtgggggcgccggcccgccgtggggtgcgggccgcctggggtccgtgcggactccggaggtccggtgtctagtggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacag

SEQ ID NO: 176417 - DNA, 584 bp, Homo sapiens
  Payload ID: 14634
  Gene Symbol: RPL17
  Gene Name: ribosomal protein L17
  Uniprot ID: P18621
  ENST ID: ENST00000581373
  CDS Start-End: 109-549
ctctttccctaagcagcctgaggtgatctgtgaaaatggttcgctattcacttgacccggagaaccccacgaaataacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaa

SEQ ID NO: 176418 - DNA, 705 bp, Homo sapiens
  Payload ID: 14634
  Gene Symbol: RPL17
  Gene Name: ribosomal protein L17
  ENST ID: ENST00000580210
  CDS Start-End: 180-704
gcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaa

SEQ ID NO: 176419 - DNA, 859 bp, Homo sapiens
  Payload ID: 14634
  Gene Symbol: RPL17
  Gene Name: ribosomal protein L17
  Uniprot ID: P18621
  ENST ID: ENST00000579408
  CDS Start-End: 270-824
tccaaagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaa

SEQ ID NO: 176420 - DNA, 684 bp, Homo sapiens
  Payload ID: 14634
  Gene Symbol: RPL17
  Gene Name: ribosomal protein L17
  ENST ID: ENST00000578532
  CDS Start-End: 172-684
gagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcc

SEQ ID NO: 176421 - DNA, 576 bp, Homo sapiens
  Payload ID: 14634
  Gene Symbol: RPL17
  Gene Name: ribosomal protein L17
  ENST ID: ENST00000583036
  CDS Start-End: 163-576
atgagttctcccaaaatccaccgctcttcctctttccctaagcagcctgagggttgactggattggtgaggcccgtgtggctacttctgtggaagcagtgctgtagttactggaagataaaagggaaagcaagcccttggtgggggaaagtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaaccca

SEQ ID NO: 176422 - DNA, 650 bp, Homo sapiens
  Payload ID: 14634
  Gene Symbol: RPL17
  Gene Name: ribosomal protein L17
  ENST ID: ENST00000615760
  CDS Start-End: 256-650
gcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccgggggttgactggattggtgaggcccgtgtggctacttctgtggaagcagtgctgtagttactggaagataaaagggaaagcaagcccttggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagc

SEQ ID NO: 176423 - DNA, 856 bp, Homo sapiens
  Payload ID: 14634
  Gene Symbol: RPL17
  Gene Name: ribosomal protein L17
  Uniprot ID: P18621
  ENST ID: ENST00000618613
  CDS Start-End: 264-818
gccgccatcctggcttcgggggcgccggcctccaggcccccgggaggagaactcctagggctactaaatcctcgctggaggcggtggcttcttatgcgggaggacgtggcggagggcctgactttgggagccggggtcagtcggcctctgagggttgactggattggtgaggcccgtgtggctacttctgtggaagcagtgctgtagttactggaagataaaagggaaagcaagcccttggtgggggaaagtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaagaa

SEQ ID NO: 176424 - DNA, 795 bp, Homo sapiens
  Payload ID: 14634
  Gene Symbol: RPL17
  Gene Name: ribosomal protein L17
  ENST ID: ENST00000617346
  CDS Start-End: 289-795
cttcctctttccctaagcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaag

SEQ ID NO: 176425 - DNA, 586 bp, Homo sapiens
  Payload ID: 14634
  Gene Symbol: RPL17
  Gene Name: ribosomal protein L17
  ENST ID: ENST00000615479
  CDS Start-End: 294-586
cgtggcggagggcctgactttgggagccgggggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgc

SEQ ID NO: 176426 - DNA, 747 bp, Homo sapiens
  Payload ID: 14634
  Gene Symbol: RPL17
  Gene Name: ribosomal protein L17
  Uniprot ID: P18621
  ENST ID: ENST00000618619
  CDS Start-End: 127-681
ttcctctttccctaagcagcctgagggttgactggattggtgaggcccgtgtggctacttctgtggaagcagtgctgtagttactggaagataaaagggaaagcaagcccttggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaagaatgttggttgtctttattagtgaacatat

SEQ ID NO: 176427 - DNA, 612 bp, Homo sapiens
  Payload ID: 14635
  Gene Symbol: RPL18
  Gene Name: ribosomal protein L18
  ENST ID: ENST00000084795
  CDS Start-End: 1-571
cccacagggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgaca

SEQ ID NO: 176428 - DNA, 541 bp, Homo sapiens
  Payload ID: 14635
  Gene Symbol: RPL18
  Gene Name: ribosomal protein L18
  ENST ID: ENST00000546623
  CDS Start-End: 1-502
ggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaagccttgtcctctccaccaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctga

SEQ ID NO: 176429 - DNA, 1004 bp, Homo sapiens
  Payload ID: 14635
  Gene Symbol: RPL18
  Gene Name: ribosomal protein L18
  Uniprot ID: Q07020
  ENST ID: ENST00000549920
  CDS Start-End: 394-960
actgggcccgccgggtcctccgggagccactgagaggccgtcggcgtcgggccagagcgtcaccgcgcgacgcatcgtgctagctacacgcatctcgctcccagatccctttcttccggaaagctatcgagaacacggcctgggtagggccagagaggcccccgacgtgctggcccttccctcttggacgttgcgcttgttcctgcgctctatgctctctgccgttatcgcccggctagtcagtcgtccaactcaccacagagaagtccggatcgtggtagagcgccgcgtcgcacccatgtgacgtcacggcggcgccactcgcttgaggctttccccgcccaccccagcccgttctctctttccggacctggccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgacagtg

SEQ ID NO: 176430 - DNA, 1111 bp, Homo sapiens
  Payload ID: 14635
  Gene Symbol: RPL18
  Gene Name: ribosomal protein L18
  ENST ID: ENST00000550973
  CDS Start-End: 722-1111
gcggcgttcggggctggataatccgctgccatccgccgtggttttgggctaggggcacgctggagggcggcagggggtctgcggctgcccggagggagcaattcccgatactggggacctactctgggggccaggaaagcagggatgggtcagtcatagcctaccgcccccacttagtagatgaccaagtggaggtactcggaggctgatatgactgggtttacaaagccaggaagtggcagagccaggattccgacccaggtggctggacccgcagccactcttagttatttggctttgctgcctttatctggacctgtcactttctagtatgaaaagtcgggttcgatgggggccgcggcgggtgagaggatcgagagccgaataactggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacaggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggcc

SEQ ID NO: 176431 - DNA, 463 bp, Homo sapiens
  Payload ID: 14635
  Gene Symbol: RPL18
  Gene Name: ribosomal protein L18
  ENST ID: ENST00000550645
  CDS Start-End: 21-422
gccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgaca

SEQ ID NO: 176432 - DNA, 628 bp, Homo sapiens
  Payload ID: 14635
  Gene Symbol: RPL18
  Gene Name: ribosomal protein L18
  ENST ID: ENST00000549370
  CDS Start-End: 34-288
ctttccggacctggccgagcaggaggcgccatcatgggagtggacatccgccataacaaggaccgaaaggttcggcgcaaggagcccaagagccaggatatctacctgaggctgttggtcaaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgc

SEQ ID NO: 176433 - DNA, 559 bp, Homo sapiens
  Payload ID: 14635
  Gene Symbol: RPL18
  Gene Name: ribosomal protein L18
  Uniprot ID: Q07020
  ENST ID: ENST00000552588
  CDS Start-End: 39-518
tctctctttccggacctggccgagcaggaggcgccatcatgttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgaca

SEQ ID NO: 176434 - DNA, 1036 bp, Homo sapiens
  Payload ID: 14635
  Gene Symbol: RPL18
  Gene Name: ribosomal protein L18
  ENST ID: ENST00000549273
  CDS Start-End: 35-529
tctttccggacctggccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaagtgagtatcaggcccccagccctgccctctccccagactcagcctgcagggccaggcctggccacacttgggctgcttctcctatccctcgtaccagccagccccaggccttctggaactctcagctgcctcatcctgcctgcttttcccttcaacactgcttggagctgtgttttccagggcctgagcaggcatctcctggggagcatgcagttcaccggcctttgccagcccaggctgggaccctccaggtggtggggcaggtgcttccatagcccctcctggctccttggcttcccactctgccaagcttttccagcagcattgactctcctggggctgaatgtgacaggcttgtggtgttcctgtgccactccacaatggcctcctttaagagggcccccctctcactccctcctctccccacagaccctacgtccgctccaagggccggaagttcgagcgtgccagaggccgacgggccagccgaggctacaaaaactaaccctgg

SEQ ID NO: 176435 - DNA, 440 bp, Homo sapiens
  Payload ID: 14635
  Gene Symbol: RPL18
  Gene Name: ribosomal protein L18
  ENST ID: ENST00000547897
  CDS Start-End: 26-440
acctggccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaagaccctacgtccgctccaagggccggaagttcgagcgtgccagaggccgacgggccagccgaggctacaaaaactaaccctggatcctactctcttattaaaaagatttttgctgacag

SEQ ID NO: 176436 - DNA, 665 bp, Homo sapiens
  Payload ID: 14636
  Gene Symbol: RPL18A
  Gene Name: ribosomal protein L18a
  Uniprot ID: Q02543
  ENST ID: ENST00000222247
  CDS Start-End: 82-612
ccggtagtgaaggcctggtgaacggctgcgcgacagaggacacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 176437 - DNA, 491 bp, Homo sapiens
  Payload ID: 14636
  Gene Symbol: RPL18A
  Gene Name: ribosomal protein L18a
  ENST ID: ENST00000599898
  CDS Start-End: 26-439
tggcggcgaacgcggagagcacgccatgaaggcctcgggcacgctacgagagtacaagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggt

SEQ ID NO: 176438 - DNA, 1391 bp, Homo sapiens
  Payload ID: 14636
  Gene Symbol: RPL18A
  Gene Name: ribosomal protein L18a
  ENST ID: ENST00000600147
  CDS Start-End: 37-501
ccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccgcacaagccacgcttcaccaccaagaggcccaacaccttcttctaggtgcagggccctcgtccgggtgtgccccaaataaactcaggaacgccccggtgctcgccgcatgttttctttgcacactgcagagctcaaaggggtgctatgagaggccggcccagtcagctcctggggtgcagctgagctgccatttctttgtcctgggaggggtcttcagtgcaaacaaacaaaccctcacatcctcctgtcctggagtgggccctccaggcgcccccacccctgagctccctcttgcttggtcagttctcagccctgctggcagccctgggctatgagctgcaggggtactgtctgtcctgggccctaaatctgtcccaactgccttgtgagacacaggcctcccaggctcccctgctgagtctggaccagggagaatctccctagatagtggggttggcgttcactccctggggattctcctaagtctctggttcccaaagttttcagagtagacacaagtgggcacccgaggggcgctctctgctgcttgggggctgtttccctttcactggttgggggcctcttagatgacgccctcatcttgcccaaggaggtcaaggactcaccacaggtactcatctctgggaaactgcctcaggcctggaaaattccaggcatgacactaatcccaccctggctgagtccttctgtcaggtggaggctaagctggcattggagaagtttgagacacagccaagagctcaggctctgggagcctcccatcctttgttgcgtgaccttgggcagccctgttctgggccagcggcccttctggggcttgctgtcttgatctcaacatcgggttccacattgatgtgggaagtgacgctgtgcaggtgctggggtcagcctatggggccctcctttgtcccaga

SEQ ID NO: 176439 - DNA, 1084 bp, Homo sapiens
  Payload ID: 14636
  Gene Symbol: RPL18A
  Gene Name: ribosomal protein L18a
  ENST ID: ENST00000599870
  CDS Start-End: 600-1043
ggattgcagttgggaaaacggaggcagccgcagctcgcgtggcaacagtgcagggatcccagggctggggagagacctgaggtcttgtcctagttctgcctggaatgggctgtgagatcccatgctggtcactgggcctcagggtgaaagaagatgttggctggatgttttgaggtgcagagtggctgtttgacggcgactgcaaagcaattcaggactgcagcatgaagaaaggaggctgtgggtctaagccacagctttcctggtctgaaacccttagcccaggcaaaggagaggcaggcaactcaattaatcctccctggagacctccctctcctcagttcattttgtgtataaagttgtggtcgggagtgtgacctacagtcaccaagaatccacatggaggccctagggtggccctgcctcctgcttcccgaatctgtggtcactagatgtaggaaagggagtgaggtggatctccacagttgcctctgggtgctggccttaccctcactcctgtttcctttcagctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcagg

SEQ ID NO: 176440 - DNA, 683 bp, Homo sapiens
  Payload ID: 14636
  Gene Symbol: RPL18A
  Gene Name: ribosomal protein L18a
  ENST ID: ENST00000597648
  CDS Start-End: 260-683
ggcggccatcgtgggagccgcgtggagagagcgatgcgtgacctgggccagctcagggatcgcgggggcccaaggactccgggtcttcttcccgggggaaggaataagtcgcgcagcatagaggccctagccccggcacctcgtcgagccgccaagtttctgttttcctttctgcaacgtggacgtggcgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaaga

SEQ ID NO: 176441 - DNA, 732 bp, Homo sapiens
  Payload ID: 14637
  Gene Symbol: RPL19
  Gene Name: ribosomal protein L19
  Uniprot ID: P84098
  ENST ID: ENST00000225430
  CDS Start-End: 63-653
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgc

SEQ ID NO: 176442 - DNA, 792 bp, Homo sapiens
  Payload ID: 14637
  Gene Symbol: RPL19
  Gene Name: ribosomal protein L19
  ENST ID: ENST00000582193
  CDS Start-End: 136-720
atgaggtgagggcgagctggtctccatcaggcgctgacgcgtgtcgacaagggactgtcggtcttgggaccgcagctggggttgggggagatgaaatggaggccgccctaaagcggccggtcccggggtttgggtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagcctt

SEQ ID NO: 176443 - DNA, 402 bp, Homo sapiens
  Payload ID: 14637
  Gene Symbol: RPL19
  Gene Name: ribosomal protein L19
  ENST ID: ENST00000585199
  CDS Start-End: 17-402
caaagggcaggtcttgatggggacgttcattcttgcccaggattggctttcagagtctaatcatgttttctgtgtgtctagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagata

SEQ ID NO: 176444 - DNA, 690 bp, Homo sapiens
  Payload ID: 14637
  Gene Symbol: RPL19
  Gene Name: ribosomal protein L19
  ENST ID: ENST00000579374
  CDS Start-End: 30-611
tctttcctttcgctgctgcggccgcagccatgaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgc

SEQ ID NO: 176445 - DNA, 1051 bp, Homo sapiens
  Payload ID: 14637
  Gene Symbol: RPL19
  Gene Name: ribosomal protein L19
  ENST ID: ENST00000579260
  CDS Start-End: 404-988
gccatgaggtgagggcgagctggtctccatcaggcgctgacgcgtgtcgacaagggactgtcggtcttgggaccgcagctggggttgggggagatgaaatggaggccgccctaaagcggccggtcccggggtttggggtaggccggagcactttcgtcccgggcctccggagtgagggggggcggggagcgtcgcagcaactgagaccaggaaaagtctgccccggctggtgccgcaccgcacacgtgtccggtcgacccacgcgagcagagcaaacggagcgaacaagaccaagccgtgggccctttcttgcttggcacacccggagcggagccgatctctgctttcacgtgatgtagggcaagcctagtgtaggccccaggcctccgactgccgagagagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaa

SEQ ID NO: 176446 - DNA, 815 bp, Homo sapiens
  Payload ID: 14638
  Gene Symbol: RPL21
  Gene Name: ribosomal protein L21
  Uniprot ID: P46778
  ENST ID: ENST00000311549
  CDS Start-End: 290-772
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 176447 - DNA, 616 bp, Homo sapiens
  Payload ID: 14638
  Gene Symbol: RPL21
  Gene Name: ribosomal protein L21
  Uniprot ID: P46778
  ENST ID: ENST00000272274
  CDS Start-End: 91-573
cttccaggtagggcctacgcgtggctcccgggcgctaggtgttcgacagacttgaaccgcgaccttgtggcctcagagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 176448 - DNA, 641 bp, Homo sapiens
  Payload ID: 14638
  Gene Symbol: RPL21
  Gene Name: ribosomal protein L21
  Uniprot ID: P46778
  ENST ID: ENST00000326092
  CDS Start-End: 116-598
gcgtggctcccgggcgctaggtgttcgacagacttgaaccgcgaccttgtggcctcagaggtcgttcattgggaccgtggggagactctctaacctgtttgagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 176449 - DNA, 806 bp, Homo sapiens
  Payload ID: 14638
  Gene Symbol: RPL21
  Gene Name: ribosomal protein L21
  Uniprot ID: P46778
  ENST ID: ENST00000319826
  CDS Start-End: 281-763
caggtagggcctacgcgtggctcccgggcgctaggtgttcgacagacttgaaccgcgaccttgtggcctcagaggtcgttcattgggaccgtggggagactctctaacctgtttgaggtccattggcatgggcgggttaaaccatgttctgccagacggggagcagcgtgcgccgggtcgggtctgggccgtgggctgagaaccggactgcgatgttgcggccctgcggggggacatttgcgagaaagacgagactgagtcgcttgggtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 176450 - DNA, 681 bp, Homo sapiens
  Payload ID: 14638
  Gene Symbol: RPL21
  Gene Name: ribosomal protein L21
  ENST ID: ENST00000461690
  CDS Start-End: 38-301
ttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaatgtttctcttcattgagtagaagtgtggtgtcctctcccccaaagaaatatttaaagcaaattttggttgtgtcctaattcattatgtaatgtccttgctattcaaatttaatgtatttcttg

SEQ ID NO: 176451 - DNA, 438 bp, Homo sapiens
  Payload ID: 14638
  Gene Symbol: RPL21
  Gene Name: ribosomal protein L21
  ENST ID: ENST00000493317
  CDS Start-End: 73-438
ggggtttggggcaaatgccagttttcagtcgtatttgactgttctgctttctggtttcagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaa
